US006972186B2

(12) United States Patent
Desnoyers et al.

(10) Patent No.: US 6,972,186 B2
(45) Date of Patent: Dec. 6, 2005

(54) NUCLEIC ACID ENCODING PRO 1410 POLYPEPTIDES

(75) Inventors: Luc Desnoyers, San Francisco, CA (US); Audrey Goddard, San Francisco, CA (US); Paul J. Godowski, Hillsborough, CA (US); Austin L. Gurney, Belmont, CA (US); Colin K. Watanabe, Moraga, CA (US); William I. Wood, Hillsborough, CA (US)

(73) Assignee: Genentech, Inc., South San Francisco, CA (US)

( * ) Notice: Subject to any disclaimer, the term of this patent is extended or adjusted under 35 U.S.C. 154(b) by 373 days.

(21) Appl. No.: 10/015,392

(22) Filed: Dec. 12, 2001

(65) Prior Publication Data

US 2003/0166901 A1 Sep. 4, 2003

Related U.S. Application Data

(63) Continuation of application No. 09/946,374, filed on Sep. 4, 2001, now abandoned, which is a continuation of application No. PCT/US00/04342, filed on Feb. 18, 2000, which is a continuation-in-part of application No. 09/403,297, filed as application No. PCT/US99/20111 on Sep. 1, 1999.
(60) Provisional application No. 60/162,506, filed on Oct. 29, 1999, and provisional application No. 60/101,476, filed on Sep. 23, 1998.

(51) Int. Cl.[7] ........................... C12P 21/06; C12N 1/20; C12N 5/00; C12N 15/74; C07H 21/04
(52) U.S. Cl. ................ 435/69.1; 435/252.3; 435/320.1; 435/325; 435/471; 536/23.5
(58) Field of Search ............................ 435/69.1, 252.3, 435/320.1, 325, 471; 530/350; 536/23.5

(56) References Cited

FOREIGN PATENT DOCUMENTS

WO    WO 00/53758    *   9/2000

OTHER PUBLICATIONS

Skolnick et al. Trends in Biotech. 18:34–39, 2000.*
Bork P. Genome Research 10:398–400, 2000.*
Doerks et al. Trends in Genetics 14:248–250, 1998.*
Smith et al. Nature Biotechnology 15:1222–1223, 1997.*
Brenner SE. Trends in Genetics 15:132–133, 1999.*
Bork, et al. Trends in Genetics 12:425–427, 1996.*
Dayhoff, Accession No.: P_AAB50967, WO 200073348–A2, Pub Date: Dec. 7, 2000, Baker, K.P., et al.
Dayhoff, Accession No.: P_AAY99415, WO 200012708–A2, Pub Date: Mar. 9, 2000, Baker, K., et al.
Dayhoff, Accession No.: P_AAB01417, WO 200039150–A2, Pub Date: Jul. 6, 2000, Sharp, J.D..
Dayhoff, Accession No.: P_AAB33455, WO 200053758–A2, Pub Date: Sep. 14, 2000, Ashkenazi, A.J., et al.
Dayhoff, Accession No.: P_AAB24023, WO 200053750–A1, Pub Date: Sep. 14, 2000, Botstein, D., et al.
GenBank, Accession No.: P_AAC58620, WO 200053758–A2, Pub Date: Sep. 14, 2000, Ashkenazi, A.J., et al.
GenBank, Accession No.: P_AAA37097, WO 200012708–A2, Pub Date: Mar. 9, 2000, Baker, K., et al.
GenBank, Accession No.: P_AAC91569, WO 200073348–A2, Pub Date: Dec. 7, 2000, Baker, K.P., et al.
GenBank, Accession No.: AX055718, WO 0073348–A3, Pub Date: Dec. 7, 2000, Baker, K.P., et al.
GenBank, Accession No.: P_AAC58105, WO 200053750–A1, Pub Date: Sep. 14, 2000, Botstein, D., et al.
GenBank, Accession No.: AAA47450, WO 200039150–A2, Pub Date: Jul. 6, 2000, Sharp, J.D..
GenBank, Accession No.: AP002990, Direct Submission, Submitted: Dec. 1, 2000, Hattori, M., et al.
GenBank, Accession No.: AC090702, Direct Submission, Submitted: Mar. 8, 2001, Birren, B., et al.
GenBank, Accession No.: AC090306, Direct Submission, Submitted: Feb. 17, 2001, Birren, B., et al.
GenBank, Accession No.: AC090232, Direct Submission, Submitted: Feb. 17, 2001, Birren, B., et al.
Hanna, J.S., et al., "HER–2/neu Breat Cancer Predictive Testing", Oathology Associates Medical Laboratories— (1999).
Hyman, E., et al., "Impact of DNA Amplification on Gene Expression Patterns in Breast Cancer[1,2]", Cancer Research—62:6240–6245 (2002).
Orntoft, T.F., et al., "Genome–wide Study of Gene Copy Numbers, Transcripts, and Protein Levels in Pairs of Non–Invasive Human Transitional Cell Carcinomas", Molecular & Cellular Proteomics—1:37–45 (2002).
Pollack, J.R., et al., "Microarray Analysis Reveals a Major Direct Role of DNA Copy Number Alteration in the Transcriptional Program of Human Breast Tumors", PNAS—99(20):12963–12968 (2002).
Schnabel, M., et al., "Osteoarthritis and Cartilage", Journal of the OsteoArthritis Research Society International, 10:62–70 (2002).
Zhang, Yaou, et al., "Versican Modulates Embryonic Chondrocyte Morphology via the Epidermal Growth Factor–like Motifs in G3", Experimental Cell Research—263:33–42 (2001).

* cited by examiner

Primary Examiner—Robert Landsman
(74) Attorney, Agent, or Firm—Elizabeth M. Barnes; Mark T. Kresnak; Ginger R. Dreger

(57) ABSTRACT

The present invention is directed to novel polypeptides and to nucleic acid molecules encoding those polypeptides. Also provided herein are vectors and host cells comprising those nucleic acid sequences, chimeric polypeptide molecules comprising the polypeptides of the present invention fused to heterologous polypeptide sequences, antibodies which bind to the polypeptides of the present invention and to methods for producing the polypeptides of the present invention.

15 Claims, 249 Drawing Sheets

FIGURE 1

CCAATCGCCCGGTGCGGTGGTGCAGGGTCTCGGGCTAGTCATGGCGTCCCCGTCTCGGAGAC
TGCAGACTAAACCAGTCATTACTTGTTTCAAGAGCGTTCTGCTAATCTACACTTTTATTTTC
TGGATCACTGGCGTTATCCTTCTTGCAGTTGGCATTTGGGGCAAGGTGAGCCTGGAGAATTA
CTTTTCTCTTTTAAATGAGAAGGCCACCAATGTCCCCTTCGTGCTCATTGCTACTGGTACCG
TCATTATTCTTTTGGGCACCTTTGGTTGTTTTGCTACCTGCCGAGCTTCTGCATGGATGCTA
AAACTGTATGCAATGTTTCTGACTCTCGTTTTTTGGTCGAACTGGTCGCTGCCATCGTAGG
ATTTGTTTTCAGACATGAGATTAAGAACAGCTTTAAGAATAATTATGAGAAGGCTTTGAAGC
AGTATAACTCTACAGGAGATTATAGAAGCCATGCAGTAGACAAGATCCAAAATACGTTGCAT
TGTTGTGGTGTCACCGATTATAGAGATTGGACAGATACTAATTATTACTCAGAAAAGGATT
TCCTAAGAGTTGCTGTAAACTTGAAGATTGTACTCCACAGAGAGATGCAGACAAAGTAAACA
ATGAAGGTTGTTTTATAAAGGTGATGACCATTATAGAGTCAGAAATGGGAGTCGTTGCAGGA
ATTTCCTTTGGAGTTGCTTGCTTCCAACTGATTGGAATCTTTCTCGCCTACTGCCWCTCTCG
TGCCATAACAAATAACCAGTATGAGATAGTGTAACCCAATGTATCTGTGGGCCTATTCCTCT
CTACCTTTAAGGACATTTAGGGTCCCCCCTGTGAATTAGAAAGTTGCTTGGCTGGAGAACTG
ACAACACTACTTACTGATAGACCAAAAAACTACACCAGTAGGTTGATTCAATCAAGATGTAT
GTAGACCTAAAACTACACCAATAGGCTGATTCAATCAAGATCCGTGCTCGCAGTGGGCTGAT
TCAATCAAGATGTATGTTTGCTATGTTCTAAGTCCACCTTCTATCCCATTCATGTTAGATCG
TTGAAACCCTGTATCCCTCTGAAACACTGGAAGAGCTAGTAAATTGTAAATGAAGT

FIGURE 2

```
></usr/seqdb2/sst/DNA/Dnaseqs.min/ss.DNA19902
><subunit 1 of 1, 245 aa, 1 stop, 1 unknown
><MW: -1, pI: 8.36, NX(S/T): 1
MASPSRRLQTKPVITCFKSVLLIYTFIFWITGVILLAVGIWGKVSLENYFSLLNEKATNVPF
VLIATGTVIILLGTFGCFATCRASAWMLKLYAMFLTLVFLVELVAAIVGFVFRHEIKNSFKN
NYEKALKQYNSTGDYRSHAVDKIQNTLHCCGVTDYRDWTDTNYYSEKGFPKSCCKLEDCTPQ
RDADKVNNEGCFIKVMTIIESEMGVVAGISFGVACFQLIGIFLAYCXSRAITNNQYEIV
```

Important features of the protein:

Signal peptide:

amino acids 1-42

Transmembrane domains:

amino acids 19-42, 61-83, 92-114, 209-230,

N-glycosylation site.

amino acids 134-138

Tyrosine kinase phosphorylation site.

amino acids 160-168, 160-169

N-myristoylation site.

amino acids 75-81, 78-84, 210-216, 214-220, 226-232

Prokaryotic membrane lipoprotein lipid attachment site.

amino acids 69-80, 211-222

FIGURE 3

CCCACGCGTCCGGCGCCGTGGCCTCGCGTCCATCTTTGCCGTTCTCTCGGACCTGTCACAAA
GGAGTCGCGCCGCCGCCGCCGCCCCCTCCCTCCGGTGGGCCCGGGAGGTAGAGAAAGTCAGT
GCCACAGCCCGACCGCGCTGCTCTGAGCCCTGGGCACGCGGAACGGGAGGGAGTCTGAGGGT
TGGGGACGTCTGTGAGGGAGGGGAACAGCCGCTCGAGCCTGGGGCGGGCGGACCGGACTGGG
GCCGGGGTAGGCTCTGGAAAGGGCCCGGGAGAGAGGTGGCGTTGGTCAGAACCTGAGAAACA
GCCGAGAGGTTTTCCACCGAGGCCCGCGCTTGAGGGATCTGAAGAGGTTCCTAGAAGAGGGT
GTTCCCTCTTTCGGGGGTCCTCACCAGAAGAGGTTCTTGGGGGTCGCCCTTCTGAGGAGGCT
GCGGCTAACAGGGCCCAGAACTGCCATTGGATGTCCAGAATCCCCTGTAGTTGATAATGTTG
GGAATAAGCTCTGCAACTTTCTTTGGCATTCAGTTGTTAAAAACAAATAGGATGCAAATTCC
TCAACTCCAGGTTATGAAAACAGTACTTGGAAAACTGAAAACTACCTAAATGATCGTCTTTG
GTTGGGCCGTGTTCTTAGCGAGCAGAAGCCTTGGCCAGGGTCTGTTGTTGACTCTCGAAGAG
CACATAGCCCACTTCCTAGGGACTGGAGGTGCCGCTACTACCATGGGTAATTCCTGTATCTG
CCGAGATGACAGTGGAACAGATGACAGTGTTGACACCCAACAGCAACAGGCCGAGAACAGTG
CAGTACCCACTGCTGACACAAGGAGCCAACCACGGGACCCTGTTCGGCCACCAAGGAGGGGC
CGAGGACCTCATGAGCCAAGGAGAAAGAAACAAAATGTGGATGGGCTAGTGTTGGACACACT
GGCAGTAATACGGACTCTTGTAGATAAGTAAGTATCTGACTCACGGTCACCTCCAGTGGAAT
GAAAAGTGTTCTGCCCGGAACCATGACTTTAGGACTCCTTCAGTTCCTTTAGGACATACTCG
CCAAGCCTTGTGCTCACAGGGCAAGGAGAATATTTTAATGCTCCGCTGATGGCAGAGTAAA
TGATAAGATTTGATGTTTTTGCTTGCTGTCATCTACTTTGTCTGGAAATGTCTAAATGTTTC
TGTAGCAGAAAACACGATAAAGCTATGATCTTTATTAGAG

FIGURE 4

MIVFGWAVFLASRSLGQGLLLTLEEHIAHFLGTGGAATTMGNSCICRDDSGTDDSVDTQQQQ
AENSAVPTADTRSQPRDPVRPPRRGRGPHEPRRKKQNVDGLVLDTLAVIRTLVDKO

Signal peptide:
amino acids 1-16

Casein kinase II phosphorylation site.
amino acids 22-26, 50-54, 113-117

N-myristoylation site.
amino acids 18-24, 32-38, 34-40, 35-41, 51-57

FIGURE 5

GGCACGAGGCGCTGTCCACCCGGGGGCGTGGGAGTGAGGTACCAGATTCAGCCCATTTGGCC
CCGACGCCTCTGTTCTCGGAATCCGGGTGCTGCGGATTGAGGTCCCGGTTCCTAACGGACTG
CAAGATGGAGGAAGGCGGGAACCTAGGAGGCCTGATTAAGATGGTCCATCTACTGGTCTTGT
CAGGTGCCTGGGGCATGCAAATGTGGGTGACCTTCGTCTCAGGCTTCCTGCTTTTCCGAAGC
CTTCCCCGACATACCTTCGGACTAGTGCAGAGCAAACTCTTCCCCTTCTACTTCCACATCTC
CATGGGCTGTGCCTTCATCAACCTCTGCATCTTGGCTTCACAGCATGCTTGGGCTCAGCTCA
CATTCTGGGAGGCCAGCCAGCTTTACCTGCTGTTCCTGAGCCTTACGCTGGCCACTGTCAAC
GCCCGCTGGCTGGAACCCCGCACCACAGCTGCCATGTGGGCCCTGCAAACCGTGGAGAAGGA
GCGAGGCCTGGGTGGGGAGGTACCAGGCAGCCACCAGGGTCCCGATCCCTACCGCCAGCTGC
GAGAGAAGGACCCCAAGTACAGTGCTCTCCGCCAGAATTTCTTCCGCTACCATGGGCTGTCC
TCTCTTTGCAATCTGGGCTGCGTCCTGAGCAATGGGCTCTGTCTCGCTGGCCTTGCCCTGGA
AATAAGGAGCCTCTAGCATGGGCCCTGCATGCTAATAAATGCTTCTTCAGAAATGAAAAAAA
AAAAAAAAAAAA

FIGURE 6

```
</usr/seqdb2/sst/DNA/Dnaseqs.min/ss.DNA56107
<subunit 1 of 1, 231 aa, 1 stop
<NX(S/T): 0
MEEGGNLGGLIKMVHLLVLSGAWGMQMWVTFVSGFLLFRSLPRHTFGLVQSKLFPFYFHISM
GCAFINLCILASQHAWAQLTFWEASQLYLLFLSLTLATVNARWLEPRTTAAMWALQTVEKER
GLGGEVPGSHQGPDPYRQLREKDPKYSALRQNFFRYHGLSSLCNLGCVLSNGLCLAGLALEIRSL
```

Signal peptide:

amino acids 1-24

Transmembrane domain:

amino acids 86-103, 60-75

Casein kinase II phosphorylation site.

amino acids 82-86

Tyrosine kinase phosphorylation site.

amino acids 144-151

N-myristoylation site.

amino acids 4-10, 5-11, 47-53, 170-176, 176-182

Prokaryotic membrane lipoprotein lipid attachment site.

amino acids 54-65

G-protein coupled receptors proteins.

amino acids 44-85

FIGURE 7

AATTCAGATTTTAAGCCCATTCTGCAGTGGAATTTCATGAACTAGCAAGAGGACACCATCTT
CTTGTATTATACAAGAAAGGAGTGTACCTATCACACACAGGGGGAAAAATGCTCTTTTGGGT
GCTAGGCCTCCTAATCCTCTGTGGTTTTCTGTGGACTCGTAAAGGAAAACTAAAGATTGAAG
ACATCACTGATAAGTACATTTTTATCACTGGATGTGACTCGGGCTTTGGAAACTTGGCAGCC
AGAACTTTTGATAAAAAGGGATTTCATGTAATCGCTGCCTGTCTGACTGAATCAGGATCAAC
AGCTTTAAAGGCAGAAACCTCAGAGAGACTTCGTACTGTGCTTCTGGATGTGACCGACCCAG
AGAATGTCAAGAGGACTGCCCAGTGGGTGAAGAACCAAGTTGGGGAGAAAGGTCTCTGGGGT
CTGATCAATAATGCTGGTGTTCCCGGCGTGCTGGCTCCCACTGACTGGCTGACACTAGAGGA
CTACAGAGAACCTATTGAAGTGAACCTGTTTGGACTCATCAGTGTGACACTAAATATGCTTC
CTTTGGTCAAGAAAGCTCAAGGGAGAGTTATTAATGTCTCCAGTGTTGGAGGTCGCCTTGCA
ATCGTTGGAGGGGGCTATACTCCATCCAAATATGCAGTGGAAGGTTTCAATGACAGCTTAAG
ACGGGACATGAAAGCTTTTGGTGTGCACGTCTCATGCATTGAACCAGGATTGTTCAAAACAA
ACTTGGCAGATCCAGTAAAGGTAATTGAAAAAAAACTCGCCATTTGGGAGCAGCTGTCTCCA
GACATCAAACAACAATATGGAGAAGGTTACATTGAAAAAAGTCTAGACAAACTGAAAGGCAA
TAAATCCTATGTGAACATGGACCTCTCTCCGGTGGTAGAGTGCATGGACCACGCTCTAACAA
GTCTCTTCCCTAAGACTCATTATGCCGCTGGAAAAGATGCCAAAATTTTCTGGATACCTCTG
TCTCACATGCCAGCAGCTTTGCAAGACTTTTTATTGTTGAAACAGAAAGCAGAGCTGGCTAA
TCCCAAGGCAGTGTGACTCAGCTAACCACAAATGTCTCCTCCAGGCTATGAAATTGGCCGAT
TTCAAGAACACATCTCCTTTTCAACCCCATTCCTTATCTGCTCCAACCTGGACTCATTTAGA
TCGTGCTTATTTGGATTGCAAAAGGGAGTCCCACCATCGCTGGTGGTATCCCAGGGTCCCTG
CTCAAGTTTTCTTTGAAAAGGAGGGCTGGAATGGTACATCACATAGGCAAGTCCTGCCCTGT
ATTTAGGCTTTGCCTGCTTGGTGTGATGTAAGGGAAATTGAAAGACTTGCCCATTCAAAATG
ATCTTTACCGTGGCCTGCCCCATGCTTATGGTCCCCAGCATTTACAGTAACTTGTGAATGTT
AAGTATCATCTCTTATCTAAATATTAAAAGATAAGTCAACCCAAAAAAAAAAAAAAAAAAA
AAAAAAAAAAAAAAAAAAA

FIGURE 8

></usr/seqdb2/sst/DNA/Dnaseqs.min/ss.DNA56406
><subunit 1 of 1, 319 aa, 1 stop
><MW: 35227, pI: 8.97, NX(S/T): 3
MLFWVLGLLILCGFLWTRKGKLKIEDITDKYIFITGCDSGFGNLAARTFDKKGFHVIAACLT
ESGSTALKAETSERLRTVLLDVTDPENVKRTAQWVKNQVGEKGLWGLINNAGVPGVLAPTDW
LTLEDYREPIEVNLFGLISVTLNMLPLVKKAQGRVINVSSVGGRLAIVGGGYTPSKYAVEGF
NDSLRRDMKAFGVHVSCIEPGLFKTNLADPVKVIEKKLAIWEQLSPDIKQQYGEGYIEKSLD
KLKGNKSYVNMDLSPVVECMDHALTSLFPKTHYAAGKDAKIFWIPLSHMPAALQDFLLLKQK
AELANPKAV

Important features of the protein:

Signal peptide:

amino acids 1-17

Transmembrane domain:

amino acids 136-152

N-glycosylation sites.

amino acids 161-163, 187-190 and 253-256

Glycosaminoglycan attachment site.

amino acids 39-42

N-myristoylation sites amino acids 36-41, 42-47, 108-113, 166-171, 198-203 and 207-212

FIGURE 9

```
GCGGGCTGTTGACGGCGCTGCGATGGCTGCCTGCGAGGGCAGGAGAAGCGGAGCTCTCGGTT
CCTCTCAGTCGGACTTCCTGACGCCGCCAGTGGGCGGGGCCCCTTGGGCCGTCGCCACCACT
GTAGTCATGTACCCACCGCCGCCGCCGCCTCATCGGGACTTCATCTCGGTGACGCTGAG
CTTTGGCGAGAGCTATGACAACAGCAAGAGTTGGCGGCGGCGCTCGTGCTGGAGGAAATGGA
AGCAACTGTCGAGATTGCAGCGGAATATGATTCTCTTCCTCCTTGCCTTTCTGCTTTTCTGT
GGACTCCTCTTCTACATCAACTTGGCTGACCATTGGAAAGCTCTGGCTTTCAGGCTAGAGGA
AGAGCAGAAGATGAGGCCAGAAATTGCTGGGTTAAAACCAGCAAATCCACCCGTCTTACCAG
CTCCTCAGAAGGCGGACACCGACCCTGAGAACTTACCTGAGATTTCGTCACAGAAGACACAA
AGACACATCCAGCGGGGACCACCTCACCTGCAGATTAGACCCCAAGCCAAGACCTGAAGGA
TGGGACCCAGGAGGAGGCCACAAAAAGGCAAGAAGCCCTGTGGATCCCCGCCCGGAAGGAG
ATCCGCAGAGGACAGTCATCAGCTGGAGGGGAGCGGTGATCGAGCCTGAGCAGGGCACCGAG
CTCCCTTCAAGAAGAGCAGAAGTGCCCACCAAGCCTCCCTGCCACCGGCCAGGACACAGGG
CACACCAGTGCATCTGAACTATCGCCAGAAGGGCGTGATTGACGTCTTCCTGCATGCATGGA
AAGGATACCGCAAGTTTGCATGGGCCATGACGAGCTGAAGCCTGTGTCCAGGTCCTTCAGT
GAGTGGTTTGGCCTCGGTCTCACACTGATCGACGCGCTGGACACCATGTGGATCTTGGGTCT
GAGGAAAGAATTTGAGGAAGCCAGGAAGTGGGTGTCGAAGAAGTTACACTTTGAAAAGGACG
TGGACGTCAACCTGTTTGAGAGCACGATCCGCATCCTGGGGGGGCTCCTGAGTGCCTACCAC
CTGTCTGGGGACAGCCTCTTCCTGAGGAAAGCTGAGGATTTTGGAAATCGGCTAATGCCTGC
CTTCAGAACACCATCCAAGATTCCTTACTCGGATGTGAACATCGGTACTGGAGTTGCCCACC
CGCCACGGTGGACCTCCGACAGCACTGTGGCCGAGGTGACCAGCATTCAGCTGGAGTTCCGG
GAGCTCTCCCGTCTCACAGGGGATAAGAAGTTTCAGGAGGCAGTGGAGAAGGTGACACAGCA
CATCCACGGCCTGTCTGGGAAGAAGGATGGGCTGGTGCCCATGTTCATCAATACCCACAGTG
GCCTCTTCACCCACCTGGGCGTATTCACGCTGGGCGCCAGGGCCGACAGCTACTATGAGTAC
CTGCTGAAGCAGTGGATCCAGGGCGGGAAGCAGGAGACACAGCTGCTGGAAGACTACGTGGA
AGCCATCGAGGGTGTCAGAACGCACCTGCTGCGGCACTCCGAGCCCAGTAAGCTCACCTTTG
TGGGGGAGCTTGCCCACGGCCGCTTCAGTGCCAAGATGGACCACCTGGTGTGCTTCCTGCCA
GGGACGCTGGCTCTGGGCGTCTACCACGGCCTGCCCGCCAGCCACATGGAGCTGGCCCAGGA
GCTCATGGAGACTTGTTACCAGATGAACCGGCAGATGGAGACGGGGCTGAGTCCCGAGATCG
TGCACTTCAACCTTTACCCCCAGCCGGGCCGTCGGGACGTGGAGGTCAAGCCAGCAGACAGG
CACAACCTGCTGCGGCCAGAGACCGTGGAGAGCCTGTTCTACCTGTACCGCGTCACAGGGGA
CCGCAAATACCAGGACTGGGGCTGGGAGATTCTGCAGAGCTTCAGCCGATTCACACGGGTCC
CCTCGGGTGGCTATTCTTCCATCAACAATGTCCAGGATCCTCAGAAGCCCGAGCCTAGGGAC
AAGATGGAGAGCTTCTTCCTGGGGGAGACGCTCAAGTATCTGTTCTTGCTCTTCTCCGATGA
CCCAAACCTGCTCAGCCTGGACGCCTACGTGTTCAACACCGAAGCCCACCCTCTGCCTATCT
GGACCCCTGCCTAGGGTGGATGGCTGCTGGTGTGGGGACTTCGGGTGGGCAGAGGCACCTTG
CTGGGTCTGTGGCATTTTCCAAGGGCCCACGTAGCACCGGCAACCGCCAAGTGGCCCAGGCT
CTGAACTGGCTCTGGGCTCCTCCTCGTCTCTGCTTTAATCAGGACACCGTGAGGACAAGTGA
GGCCGTCAGTCTTGGTGTGATGCGGGGTGGGCTGGGCCGCTGGAGCCTCCGCCTGCTTCCTC
CAGAAGACACGAATCATGACTCACGATTGCTGAAGCCTGAGCAGGTCTCTGTGGGCCGACCA
GAGGGGGGCTTCGAGGTGGTCCCTGGTACTGGGGTGACCGAGTGGACAGCCCAGGGTGCAGC
TCTGCCCGGGCTCGTGAAGCCTCAGATGTCCCCAATCCAAGGGTCTGGAGGGGCTGCCGTGA
CTCCAGAGGCCTGAGGCTCCAGGGCTGGCTCTGGTGTTTACAAGCTGGACTCAGGGATCCTC
CTGGCCGCCCCGCAGGGGGCTTGGAGGGCTGGACGGCAAGTCCGTCTAGCTCACGGGCCCCT
CCAGTGGAATGGGTCTTTTCGGTGGAGATAAAAGTTGATTTGCTCTAACCGCAA
```

FIGURE 10

></usr/seqdb2/sst/DNA/Dnaseqs.min/ss.DNA56529
><subunit 1 of 1, 699 aa, 1 stop
><MW: 79553, pI: 7.83, NX(S/T): 0
MAACEGRRSGALGSSQSDFLTPPVGGAPWAVATTVVMYPPPPPPPHRDFISVTLSFGESYDN
SKSWRRRSCWRKWKQLSRLQRNMILFLLAFLLFCGLLFYINLADHWKALAFRLEEEQKMRPE
IAGLKPANPPVLPAPQKADTDPENLPEISSQKTQRHIQRGPPHLQIRPPSQDLKDGTQEEAT
KRQEAPVDPRPEGDPQRTVISWRGAVIEPEQGTELPSRRAEVPTKPPLPPARTQGTPVHLNY
RQKGVIDVFLHAWKGYRKFAWGHDELKPVSRSFSEWFGLGLTLIDALDTMWILGLRKEFEEA
RKWVSKKLHFEKDVDVNLFESTIRILGGLLSAYHLSGDSLFLRKAEDFGNRLMPAFRTPSKI
PYSDVNIGTGVAHPPRWTSDSTVAEVTSIQLEFRELSRLTGDKKFQEAVEKVTQHIHGLSGK
KDGLVPMFINTHSGLFTHLGVFTLGARADSYYEYLLKQWIQGGKQETQLLEDYVEAIEGVRT
HLLRHSEPSKLTFVGELAHGRFSAKMDHLVCFLPGTLALGVYHGLPASHMELAQELMETCYQ
MNRQMETGLSPEIVHFNLYPQPGRRDVEVKPADRHNLLRPETVESLFYLYRVTGDRKYQDWG
WEILQSFSRFTRVPSGGYSSINNVQDPQKPEPRDKMESFFLGETLKYLFLLFSDDPNLLSLD
AYVFNTEAHPLPIWTPA

Important features of the protein:

Transmembrane domain:

amino acids 21-40 and 84-105 (type II)

FIGURE 11

```
GGCGCCGCGTAGGCCCGGGAGGCCGGGCCGGCCGGGCTGCGAGCGCCTGCCCCATGCGCCGC
CGCCTCTCCGCACGATGTTCCCCTCGCGGAGGAAAGCGGCGCAGCTGCCCTGGGAGGACGGC
AGGTCCGGGTTGCTCTCCGGCGGCCTCCCTCGGAAGTGTTCCGTCTTCCACCTGTTCGTGGC
CTGCCTCTCGCTGGGCTTCTTCTCCCTACTCTGGCTGCAGCTCAGCTGCTCTGGGGACGTGG
CCCGGGCAGTCAGGGGACAAGGGCAGGAGACCTCGGGCCCTCCCCGTGCCTGCCCCCCAGAG
CCGCCCCCTGAGCACTGGGAAGAAGACGCATCCTGGGGCCCCCACCGCCTGGCAGTGCTGGT
GCCCTTCCGCGAACGCTTCGAGGAGCTCCTGGTCTTCGTGCCCCACATGCGCCGCTTCCTGA
GCAGGAAGAAGATCCGGCACCACATCTACGTGCTCAACCAGGTGGACCACTTCAGGTTCAAC
CGGGCAGCGCTCATCAACGTGGGCTTCCTGGAGAGCAGCAACAGCACGGACTACATTGCCAT
GCACGACGTTGACCTGCTCCCTCTCAACGAGGAGCTGGACTATGGCTTTCCTGAGGCTGGGC
CCTTCCACGTGGCCTCCCCGGAGCTCCACCCTCTCTACCACTACAAGACCTATGTCGGCGGC
ATCCTGCTGCTCTCCAAGCAGCACTACCGGCTGTGCAATGGGATGTCCAACCGCTTCTGGGG
CTGGGGCCGCGAGGACGACGAGTTCTACCGGCGCATTAAGGGAGCTGGGCTCCAGCTTTTCC
GCCCCTCGGGAATCACAACTGGGTACAAGACATTTCGCCACCTGCATGACCCAGCCTGGCGG
AAGAGGGACCAGAAGCGCATCGCAGCTCAAAAACAGGAGCAGTTCAAGGTGGACAGGGAGGG
AGGCCTGAACACTGTGAAGTACCATGTGGCTTCCCGCACTGCCCTGTCTGTGGGCGGGGCCC
CCTGCACTGTCCTCAACATCATGTTGGACTGTGACAAGACCGCCACACCCTGGTGCACATTC
AGCTGAGCTGGATGGACAGTGAGGAAGCCTGTACCTACAGGCCATATTGCTCAGGCTCAGGA
CAAGGCCTCAGGTCGTGGGCCCAGCTCTGACAGGATGTGGAGTGGCCAGGACCAAGACAGCA
AGCTACGCAATTGCAGCCACCCGGCCGCCAAGGCAGGCTTGGGCTGGGCCAGGACACGTGGG
GTGCCTGGGACGCTGCTTGCCATGCACAGTGATCAGAGAGAGGCTGGGGTGTGTCCTGTCCG
GGACCCCCCTGCCTTCCTGCTCACCCTACTCTGACCTCCTTCACGTGCCCAGGCCTGTGGG
TAGTGGGGAGGGCTGAACAGGACAACCTCTCATCACCCTACTCTGACCTCCTTCACGTGCCC
AGGCCTGTGGGTAGTGGGGAGGGCTGAACAGGACAACCTCTCATCACCCCAAAAAAAAAAA
AAAAAAAAAAAAAAAAAAAAAAAAAAAAAAA
```

FIGURE 12

></usr/seqdb2/sst/DNA/Dnaseqs.min/ss.DNA56531
><subunit 1 of 1, 327 aa, 1 stop
><MW: 37406, pI: 9.30, NX(S/T): 1
MFPSRRKAAQLPWEDGRSGLLSGGLPRKCSVFHLFVACLSLGFFSLLWLQLSCSGDVARAVR
GQGQETSGPPRACPPEPPPEHWEEDASWGPHRLAVLVPFRERFEELLVFVPHMRRFLSRKKI
RHHIYVLNQVDHFRFNRAALINVGFLESSNSTDYIAMHDVDLLPLNEELDYGFPEAGPFHVA
SPELHPLYHYKTYVGGILLLSKQHYRLCNGMSNRFWGWGREDDEFYRRIKGAGLQLFRPSGI
TTGYKTFRHLHDPAWRKRDQKRIAAQKQEQFKVDREGGLNTVKYHVASRTALSVGGAPCTVL
NIMLDCDKTATPWCTFS

Signal peptide:

amino acids 1-42

Transmembrane domain:

amino acids 29-49 (type II)

N-glycosylation site.

amino acids 154-158 cAMP- and cGMP-dependent protein kinase phosphorylation site.

amino acids 27-31

Tyrosine kinase phosphorylation site.

amino acids 226-233

N-myristoylation site.

amino acids 19-25, 65-71, 247-253, 285-291, 303-309, 304-310

FIGURE 13

CAATGTTTGCCTATCCACCTCCCCCAAGCCCCTTTACCTATGCTGCTGCTAACGCTGCTGCT
GCTGCTGCTGCTTAAAGGCTCATGCTTGGAGTGGGGACTGGTCGGTGCCCAGAAAGTCT
CTTCTGCCACTGACGCCCCCATCAGGGATTGGGCCTTCTTTCCCCCTTCCTTTCTGTGTCTC
CTGCCTCATCGGCCTGCCATGACCTGCAGCCAAGCCCAGCCCCGTGGGGAAGGGGAGAAAGT
GGGGATGGCTAAGAAAGCTGGGAGATAGGGAACAGAAGAGGGTAGTGGGTGGGCTAGGGGG
GCTGCCTTATTTAAAGTGGTTGTTTATGATTCTTATACTAATTTATACAAAGATATTAAGGC
CCTGTTCATTAAGAAATTGTTCCCTTCCCCTGTGTTCAATGTTTGTAAAGATTGTTCTGTGT
AAATATGTCTTTATAATAAACAGTTAAAAGCTGAAAAAAAAAAAAAAAAAAAAAAAAAAA

FIGURE 14

```
</usr/seqdb2/sst/DNA/Dnaseqs.min/ss.DNA56862
<subunit 1 of 1, 73 aa, 1 stop
<MW: 7879, pI: 7.21, NX(S/T): 0
MLLLTLLLLLLLLKGSCLEWGLVGAQKVSSATDAPIRDWAFFPPSFLCLLPHRPAMTCSQAQ
PRGEGEKVGDG
```

Important features:

Signal peptide:

amino acids 1-15

Growth factor and cytokines receptors family:

amino acids 3-18

FIGURE 15

```
GGGACCCATGCGGCCGTGACCCCCGGCTCCCTAGAGGCCCAGCGCAGCCGCAGCGGACAAAG
GAGCATGTCCGCGCCGGGGAAGGCCCGTCCTCCGGCCGCCATAAGGCTCCGGTCGCCGCTGG
GCCCGCGCCGCGCTCCTGCCCGCCCGGGCTCCGGGGCGGCCCGCTAGGCCAGTGCGCCGCCG
CTCGCCCCGCAGGCCCCGGCCCGCAGCATGGAGCCACCCGGACGCCGGCGGGGCCGCGCGCA
GCCGCCGCTGTTGCTGCCGCTCTCGCTGTTAGCGCTGCTCGCGCTGCTGGGAGGCGGCGGCG
GCGGCGGCGCCGCGGCGCTGCCCGCCGGCTGCAAGCACGATGGGCGGCCCCGAGGGGCTGGC
AGGGCGGCGGGCGCCGCCGAGGGCAAGGTGGTGTGCAGCAGCCTGGAACTCGCGCAGGTCCT
GCCCCAGATACTCTGCCCAACCGCACGGTCACCCTGATTCTGAGTAACAATAAGATATCCG
AGCTGAAGAATGGCTCATTTTCTGGGTTAAGTCTCCTTGAAAGATTGGACCTCCGAAACAAT
CTTATTAGTAGTATAGATCCAGGTGCCTTCTGGGGACTGTCATCTCTAAAAAGATTGGATCT
GACAAACAATCGAATAGGATGTCTGAATGCAGACATATTTCGAGGACTCACCAATCTGGTTC
GGCTAAACCTTTCGGGGAATTTGTTTTCTTCATTATCTCAAGGAACTTTTGATTATCTTGCG
TCATTACGGTCTTTGGAATTCCAGACTGAGTATCTTTTGTGTGACTGTAACATACTGTGGAT
GCATCGCTGGGTAAAGGAGAAGAACATCACGGTACGGGATACCAGGTGTGTTTATCCTAAGT
CACTGCAGGCCCAACCAGTCACAGGCGTGAAGCAGGAGCTGTTGACATGCGACCCTCCGCTT
GAATTGCCGTCTTTCTACATGACTCCATCTCATCGCCAAGTTGTGTTTGAAGGAGACAGCCT
TCCTTTCCAGTGCATGGCTTCATATATTGATCAGGACATGCAAGTGTTGTGGTATCAGGATG
GGAGAATAGTTGAAACCGATGAATCGCAAGGTATTTTTGTTGAAAAGAACATGATTCACAAC
TGCTCCTTGATTGCAAGTGCCCTAACCATTTCTAATATTCAGGCTGGATCTACTGGAAATTG
GGGCTGTCATGTCCAGACCAAACGTGGGAATAATACGAGGACTGTGGATATTGTGGTATTAG
AGAGTTCTGCACAGTACTGTCCTCCAGAGAGGGTGGTAAACAACAAAGGTGACTTCAGATGG
CCCAGAACATTGGCAGGCATTACTGCATATCTGCAGTGTACGCGGAACACCCATGGCAGTGG
GATATATCCCGGAAACCCACAGGATGAGAGAAAAGCTTGGCGCAGATGTGATAGAGGTGGCT
TTTGGGCAGATGATGATTATTCTCGCTGTCAGTATGCAAATGATGTCACTAGAGTTCTTTAT
ATGTTTAATCAGATGCCCCTCAATCTTACCAATGCCGTGGCAACAGCTCGACAGTTACTGGC
TTACACTGTGGAAGCAGCCAACTTTTCTGACAAAATGGATGTTATATTTGTGGCAGAAATGA
TTGAAAAATTTGGAAGATTTACCAAGGAGGAAAAATCAAAAGAGCTAGGTGACGTGATGGTT
GACATTGCAAGTAACATCATGTTGGCTGATGAACGTGTCCTGTGGCTGGCGCAGAGGGAAGC
TAAAGCCTGCAGTAGGATTGTGCAGTGTCTTCAGCGCATTGCTACCTACCGGCTAGCCGGTG
GAGCTCACGTTTATTCAACATATTCACCCAATATTGCTCTGGAAGCTTATGTCATCAAGTCT
ACTGGCTTCACGGGGATGACCTGTACCGTGTTCCAGAAAGTGGCAGCCTCTGATCGTACAGG
ACTTTCGGATTATGGGAGGCGGGATCCAGAGGGAAACCTGGATAAGCAGCTGAGCTTTAAGT
GCAATGTTTCAAATACATTTTCGAGTCTGGCACTAAAGGTATGTTACATTCTGCAATCATTT
AAGACTATTTACAGTTAAATTAGAATGCTCCAAATGTTCTGCTTCGCAAAATAACCTTATTA
AAAGATTTTTTTTGCAGGAAGATAGGTATTATTGCTTTTGCTACTGTTTAAAGAAAACTA
ACCAGGAAGAACTGCATTACGACTTTCAAGGGCCCTAGGCATTTTTGCCTTTGATTCCCTTT
CTTCACATAAAAATATCAGAAATTACATTTTATAACTGCAGTGGTATAAATGCAAATATACT
ATTGTTACATGTGAAAAAATTTTATTTGACTTAAAAGTTTATTTATTTGTTTTTTTGCTCCT
GATTTTAAGACAATAAGATGTTTTCATGGGCCCCTAAAAGTATCATGAGCCTTTGGCACTGC
GCCTGCCAAGCCTAGTGGAGAAGTCAACCCTGAGACCAGGTGTTTAATCAAGCAAGCTGTAT
ATCAAAATTTTTGGCAGAAAACACAAATATGTCATATATCTTTTTTAAAAAAAGTATTTCA
TTGAAGCAAGCAAAATGAAAGCATTTTTACTGATTTTTAAAATTGGTGCTTTAGATATATTT
GACTACACTGTATTGAAGCAAATAGAGGAGGCACAACTCCAGCACCCTAATGGAACCACATT
TTTTTCACTTAGCTTTCTGTGGGCATGTGTAATTGTATTCTCTGCGGTTTTTAATCTCACAG
TACTTTATTTCTGTCTTGTCCCTCAATAATATCACAAACAATATTCCAGTCATTTTAATGGC
TGCATAATAACTGATCCAACAGGTGTTAGGTGTTCTGGTTTAGTGTGAGCACTCAATAAATA
TTGAATGAATGAACGAAAAAAAAAAAAAAA
```

FIGURE 16

```
MEPPGRRRGRAQPPLLLPLSLLALLALLGGGGGGGAAALPAGCKHDGRPRGAGRAAGAAEGK
VVCSSLELAQVLPPDTLPNRTVTLILSNNKISELKNGSFSGLSLLERLDLRNNLISSIDPGA
FWGLSSLKRLDLTNNRIGCLNADIFRGLTNLVRLNLSGNLFSSLSQGTFDYLASLRSLEFQT
EYLLCDCNILWMHRWVKEKNITVRDTRCVYPKSLQAQPVTGVKQELLTCDPPLELPSFYMTP
SHRQVVFEGDSLPFQCMASYIDQDMQVLWYQDGRIVETDESQGIFVEKNMIHNCSLIASALT
ISNIQAGSTGNWGCHVQTKRGNNTRTVDIVVLESSAQYCPPERVVNNKGDFRWPRTLAGITA
YLQCTRNTHGSGIYPGNPQDERKAWRRCDRGGFWADDDYSRCQYANDVTRVLYMFNQMPLNL
TNAVATARQLLAYTVEAANFSDKMDVIFVAEMIEKFGRFTKEEKSKELGDVMVDIASNIMLA
DERVLWLAQREAKACSRIVQCLQRIATYRLAGGAHVYSTYSPNIALEAYVIKSTGFTGMTCT
VFQKVAASDRTGLSDYGRRDPEGNLDKQLSFKCNVSNTFSSLALKVCYILQSFKTIYS
```

Signal peptide:

amino acids 1-33

Transmembrane domain:

amino acids 13-40 (type II)

N-glycosylation site.

amino acids 81-85, 98-102, 159-163, 206-210, 301-305, 332-336, 433-437, 453-457, 592-596

N-myristoylation site.

amino acids 29-35, 30-36, 31-37, 32-38, 33-39, 34-40, 51-57, 57-63, 99-105, 123-129, 142-148, 162-168, 317-323, 320-326, 384-390, 403-409, 554-560

FIGURE 17

GCGTGGGGATGTCTAGGAGCTCGAAGGTGGTGCTGGGCCTCTCGGTGCTGCTGACGGCGGCC
ACAGTGGCCGGCGTACATGTGAAGCAGCAGTGGGACCAGCAGAGGCTTCGTGACGGAGTTAT
CAGAGACATTGAGAGGCAAATTCGGAAAAAAGAAAACATTCGTCTTTTGGGAGAACAGATTA
TTTTGACTGAGCAACTTGAAGCAGAAAGAGAGAAGATGTTATTGGCAAAAGGATCTCAAAAA
TCATGACTTGAATGTGAAATATCTGTTGGACAGACAACACGAGTTTGTGTGTGTGTTGAT
GGAGAGTAGCTTAGTAGTATCTTCATCTTTTTTTTGGTCACTGTCCTTTTAAACTTGATCA
AATAAAGGACAGTGGGTCATATAAGTTACTGCTTTCAGGGTCCCTTATATCTGAATAAAGGA
GTGTGGGCAGACACTTTTTGGAAGAGTCTGTCTGGGTGATCCTGGTAGAAGCCCCATTAGGG
TCACTGTCCAGTGCTTAGGGTTGTTACTGAGAAGCACTGCCGAGCTTGTGAGAAGGAAGGGA
TGGATAGTAGCATCCACCTGAGTAGTCTGATCAGTCGGCATGATGACGAAGCCACGAGAACA
TCGACCTCAGAAGGACTGGAGGAAGGTGAAGTGGAGGGAGAGACGCTCCTGATCGTCGAATCC

FIGURE 18

MSRSSKVVLGLSVLLTAATVAGVHVKQQWDQQRLRDGVIRDIERQIRKKENIRLLGEQIILT
EQLEAEREKMLLAKGSQKS

Signal peptide:

amino acids 1-21

FIGURE 19

```
CTGTCGTCTTTGCTTCAGCCGCAGTCGCCACTGGCTGCCTGAGGTGCTCTTACAGCCTGTTC
CAAGTGTGGCTTAATCCGTCTCCACCACCAGATCTTTCTCCGTGGATTCCTCTGCTAAGACC
GCTGCCATGCCAGTGACGGTAACCCGCACCACCATCACAACCACCACGACGTCATCTTCGGG
CCTGGGGTCCCCCATGATCGTGGGGTCCCCTCGGGCCCTGACACAGCCCCTGGGTCTCCTTCGC
CTGCTGCAGCTGGTGTCTACCTGCGTGGCCTTCTCGCTGGTGGCTAGCGTGGGCGCCTGGAC
GGGGTCCATGGGCAACTGGTCCATGTTCACCTGGTGCTTCTGCTTCTCCGTGACCCTGATCA
TCCTCATCGTGGAGCTGTGCGGGCTCCAGGCCCGCTTCCCCCTGTCTTGGCGCAACTTCCCC
ATCACCTTCGCCTGCTATGCGGCCCTCTTCTGCCTCTCGGCCTCCATCATCTACCCCACCAC
CTATGTCCAGTTCCTGTCCCACGGCCGTTCGCGGGACCACGCCATCGCCGCCACCTTCTTCT
CCTGCATCGCGTGTGTGGCTTACGCCACCGAAGTGGCCTGGACCCGGGCCCGGCCCGGCGAG
ATCACTGGCTATATGGCCACCGTACCCGGGCTGCTGAAGGTGCTGGAGACCTTCGTTGCCTG
CATCATCTTCGCGTTCATCAGCGACCCCAACCTGTACCAGCACCAGCCGGCCCTGGAGTGGT
GCGTGGCGGTGTACGCCATCTGCTTCATCCTAGCGGCCATCGCCATCCTGCTGAACCTGGGG
GAGTGCACCAACGTGCTACCCATCCCCTTCCCCAGCTTCCTGTCGGGGCTGGCCTTGCTGTC
TGTCCTCCTCTATGCCACCGCCCTTGTTCTCTGGCCCCTCTACCAGTTCGATGAGAAGTATG
GCGGCCAGCCTCGGCGCTCGAGAGATGTAAGCTGCAGCCGCAGCCATGCCTACTACGTGTGT
GCCTGGGACGCCGACTGGCTGTGGCCATCCTGACGGCCATCAACCTACTGGCGTATGTGGC
TGACCTGGTGCACTCTGCCCACCTGGTTTTTGTCAAGGTCTAAGACTCTCCCAAGAGGCTCC
CGTTCCCTCTCCAACCTCTTTGTTCTTCTTGCCCGAGTTTTCTTTATGGAGTACTTCTTTCC
TCCGCCTTTCCTCTGTTTTCCTCTTCCTGTCTCCCCTCCCTCCCACCTTTTCTTTCCTTCC
CAATTCCTTGCACTCTAACCAGTTCTTGGATGCATCTTCTTCCTTCCCTTTCCTCTTGCTGT
TTCCTTCCTGTGTTGTTTTGTTGCCCACATCCTGTTTTCACCCCTGAGCTGTTTCTCTTTTT
CTTTTCTTTCTTTTTTTTTTTTTTTTTTAAGACGGATTCTCACTCTGTGGCCCAGGCTGGAG
TGCAGTGGTGCGATCTCAGCTCACTGCAACCCCGCCTCCTGGGTTCAAGCGATTCTCCTCC
CCCAGCCTCCCAAGTAGCTGGGAGGACAGGTGTGAGCTGCCGCACCCAGCCTGTTTCTCTTT
TTCCACTCTTCTTTTTTCTCATCTCTTTTCTGGGTTGCCTGTCGGCTTTCTTATCTGCCTGT
TTTGCAAGCACCTTCTCCTGTGTCCTTGGGAGCCCTGAGACTTCTTTCTCTCCTTGCCTCCA
CCCACCTCCAAAGGTGCTGAGCTCACATCCACACCCCTTGCAGCCGTCCATGCCACAGCCCC
CCAAGGGGCCCCATTGCCAAAGCATGCCTGCCCACCCTCGCTGTGCCTTAGTCAGTGTGTAC
GTGTGTGTGTGTGTTTGGGGGGTGGGGGTGGGTAGCTGGGGATTGGGCCCTCTTTCT
CCCAGTGGAGGAAGGTGTGCAGTGTACTTCCCCTTTAAATTAAAAAACATATATATATATAT
ATTTGGAGGTCAGTAATTTCCAATGGGCGGGAGGCATTAAGCACCGACCCTGGGTCCCTAGG
CCCCGCCTGGCACTCAGCCTTGCCAGAGATTGGCTCCAGAATTTTTGCCAGGCTTACAGAACAC
CCACTGCCTAGAGGCCATCTTAAAGGAAGCAGGGGCTGGATGCCTTTCATCCCAACTATTCT
CTGTGGTATGAAAAAG
```

FIGURE 20

</usr/seqdb2/sst/DNA/Dnaseqs.min/ss.DNA58727
<subunit 1 of 1, 322 aa, 1 stop
<MW: 35274, pI: 8.57, NX(S/T): 1

MPVTVTRTTITTTTTSSSGLGSPMIVGSPRALTQPLGLLRLLQLVSTCVAFSLVASVGAWTG
SMGNWSMFTWCFCFSVTLIILIVELCGLQARFPLSWRNFPITFACYAALFCLSASIIYPTTY
VQFLSHGRSRDHAIAATFFSCIACVAYATEVAWTRARPGEITGYMATVPGLLKVLETFVACI
IFAFISDPNLYQHQPALEWCVAVYAICFILAAIAILLNLGECTNVLPIPFPSFLSGLALLSV
LLYATALVLWPLYQFDEKYGGQPRRSRDVSCSRSHAYYVCAWDRRLAVAILTAINLLAYVAD
LVHSAHLVFVKV

Important features:

Transmembrane domains:

amino acids 41-60 (type II), 66-85, 101-120, 137-153, 171-192, 205-226, 235-255 and 294-312

N-glycosylation site.

amino acids 66-69

Glycosaminoglycan attachment site.

amino acids 18-21

FIGURE 21

```
GAACGTGCCACCATGCCCAGCTAATTTTTGTATTTTTAGTAGAGACGGGGTTTCACCATGTTGGCCAGGCTGGTC
TTGAACTCGTGACCTCATGATCCGCTCACCTCGGCCTCCCAAAGTGCTGGGATTACAGGCATGAGCCACTGACGC
CTGGCCAGCCTATGCATTTTTAAGAAATTATTCTGTATTAGGTGCTGTGCTAAACATTGGGCACTACAGTGACCA
AAACAGACTGAATTCCCCAAGAGCCAAAGACCAGTGAGGGAGACCAACAAGAAACAGGAAATGCAAAAGAGACCA
TTATTACTCACTATGACTAAGGGTCACAAATGGGGTACGTTGATGGAGAGTGATTTGTTAAGAGACTACAGAGGG
AGGACAGACTACCAAGAGGGGGGCCAGGAAAGCTCCTCTGACGAGGTGGTATTTCAGCCCAAACTGGAAGAATGA
GAAAGAGCTAGCCAGCCATCAGAATAGTCCAGAAGAGATGGGGAGCACTACACTCACTACACTTTGGCCTGAGAA
AATAGCATGGGATTGGAGGAGGCTGGGGGAACACCACTTCTGCCGACCTGGGCAGGAGGCATTGAGGGCTTGAGA
AAGGGCAATGGCAGTAGCAGTAGAAAGGACAGGGTAGGAGCAGGGACTTTGCAGGTGGAATCATTAGGTCTTATC
AACAGATATGGGCAAGCAAAGCCAGGGGAGAATTGATGGTAATGCTGAGGTTTGGAGCCAGGCTAGATGGGACAG
TGGTGGGTGATGCAAAGGAAAGAGGTCAGGAAGCAGGGCCAGACGTGGGGAGAAGGTGTGGGGGTTTGGTTTCCA
TCTTGCCGAGTCTGCCGGAATGTGGATGGGAAGACCAAGAGGAGGAGCAAGGGGCAGAGGGGAAGGGAATCTTAA
AGAAGTCCTGGATGCCACACTCTTCTTCCTTCCTCCTCTTCCCTCTCCTCAGAGGTCTCACTCGTGGTTCTTCAT
TTCCTGCCCTGCCTCCATCTCCTCTGGGTGCTGGGAAAGTGGAGGATTAGCTGAAGTTTTGCTTCTCGGGGCCTG
TCTGAATCTCCATTGCTTTCTGGGAGGACATAATTCACCTGTCCTAGCTTCTTATCATCTTACATTTCCCTGTAG
CCACTGGGACATATGTGGTGTTCCTTCCTAGCTCCTGTCTCCTCCTCATGCCTTTGCTGGGTATGGGCATGTTAG
GGGGAAGGTCATTGCTGTCAGAGGGGCACTGACTTTCTAATGGTGTTACCCAAGGTGAATGTTGGAGACACAGTC
GCGATGCTGCCCAAGTCCCGGCGAGCCCTAACTATCCAGGAGATCGCTGCGCTGGCCAGGTCCTCCCTGCATGGT
ATGCAGCCCCTCCCATGTTTCTGGCCACTTTGTCCTTTCTCCTCCCGTTTGCACATCCCTTTGGAACTGTTTCCT
GTGAGTACATGCTGGGGTCTCCCCTTTCTTCCCTTGCTCAGGTGAATCTCAGCCCCTTCTCCCACCCAAAGGTTC
ACATGGATCCTAACTACTGCCACCCTTCCACCTCCCTGCACCTGTGCTCCCTGGCCTGGTCCTTTACCAGGCTTC
TCCACCCTCCCCTATCTCCAGGTATTTCCCAGGTGGTGAAGGACCACGTGACCAAGCCTACCGCCATGGCCCAGG
GCCGAGTGGCTCACCTCATTGAGTGGAAGGGCTGGAGCAAGCCGAGTGACTCACCTGCTGCCCTGGAATCAGCCT
TTTCCTCCTATTCAGACCTCAGCGAGGGCGAACAAGAGGCTCGCTTTGCAGGAGGAGTGGCTGAGCAGTTTGCCA
TCGCGGAAGCCAAGCTCCGAGCATGGTCTTCGGTGGATGGCGAGGACTCCACTGATGACTCCTATGATGAGGACT
TTGCTGGGGGAATGGACACAGACATGGCTGGGCAGCTGCCCCTGGGGCCGCACCTCCAGGACCTGTTCACCGGCC
ACCGGTTCTCCCGGCCTGTGCGCCAGGGCTCCGTGGAGCCTGAGAGCGACTGCTCACAGACCGTGTCCCCAGACA
CCCTGTGCTCTAGTCTGTGCAGCCTGGAGGATGGGTTGTTGGGCTCCCCGGCCCGGCTGCCTCCCAGCTGCTGG
GCGATGAGCTGCTTCTCGCCAAACTGCCCCCCAGCCGGGAAAGTGCCTTCCGCAGCCTGGGCCCACTGGAGGCCC
AGGACTCACTCTACAACTCGCCCCTCACAGAGTCCTGCCTTTCCCCCGCGGAGGAGGAGCCAGCCCCCTGCAAGG
ACTGCCAGCCACTCTGCCCACCACTAACGGGCAGCTGGGAACGGCAGCGGCAAGCCTCTGACCTGGCCTCTTCTG
GGGTGGTGTCCTTAGATGAGGATGAGGCAGAGCCAGAGGAACAGTGACCCACATCATGCCTGGCAGTGGCATGCA
TCCCCCGGCTGCTGCCAGGGGCAGAGCCTCTGTGCCCAAGTGTGGGCTCAAGGCTCCCAGCAGAGCTCCACAGCC
TAGAGGGCTCCTGGGAGCGCTCGCTTCTCCGTTGTGTGTTTTGCATGAAAGTGTTTGGAGAGGAGGCAGGGGCTG
GGCTGGGGGCGCATGTCCTGCCCCCACTCCCGGGGCTTGCCGGGGGTTGCCCGGGGCCTCTGGGGCATGGCTACA
GCTGTGGCAGACAGTGATGTTCATGTTCTTAAAATGCCACACACACATTTCCTCCTCGGATAATGTGAACCACTA
AGGGGGTTGTGACTGGGCTGTGTGAGGGTGGGGTGGGAGGGGGGCCCAGCAACCCCCCACCCTCCCCATGCCTCTC
TCTTCTCTGCTTTTCTTCTCACTTCCGAGTCCATGTGCAGTGCTTGATAGAATCACCCCCACCTGGAGGGGCTGG
CTCCTGCCCTCCCGGAGCCTATGGGTTGAGCCGTCCCTCAAGGGCCCCTGCCCAGCTGGGCTCGTGCTGTGCTTC
ATTCACCTCTCCATCGTCTCTAAATCTTCCTCTTTTTTCCTAAAGACAGAAGGTTTTTGGTCTGTTTTTTCAGTC
GGATCTTCTCTTCTCTGGGAGGCTTTGGAATGATGAAAGCATGTACCCTCCACCCTTTTCCTGGCCCCCTAATGG
GGCCTGGGCCCTTTCCCAACCCCTCCTAGGATGTGCGGGCAGTGTGCTGGCGCCTCACAGCCAGCCGGGCTGCCC
ATTCACGCAGAGCTCTCTGAGCGGGAGGTGGAAGAAAGGATGGCTCTGGTTGCCACAGAGCTGGGACTTCATGTT
CTTCTAGAGAGGGCCACAAGAGGGCCACAGGGGTGGCCGGGAGTTGTCAGCTGATGCCTGCTGAGAGGCAGGAAT
TGTGCCAGTGAGTGACAGTCATGAGGGAGTGTCTCTTCTTGGGGAGGAAAGAAGGTAGAGCCTTTCTGTCTGAAT
GAAAGGCCAAGGCTACAGTACAGGGCCCCGCCCCAGCCAGGGTGTTAATGCCCACGTAGTGGAGGCCTCTGGCAG
ATCCTGCATTCCAAGGTCACTGGACTGTACGTTTTTATGGTTGTGGGAAGGGTGGGTGGCTTTAGAATTAAGGGC
CTTGTAGGCTTTGGCAGGTAAGAGGGCCCAAGGTAAGAACGAGAGCCAACGGGCACAAGCATTCTATATATAAGT
GGCTCATTAGGTGTTTATTTTGTTCTATTTAAGAATTTGTTTTATTAAATTAATATAAAAATCTTTGTAAATCTC
TAAAA
```

FIGURE 22

MFLATLSFLLPFAHPFGTVSCEYMLGSPLSSLAQVNLSPFSHPKVHMDPNYCHPSTSLHLCS
LAWSFTRLLHPPLSPGISQVVKDHVTKPTAMAQGRVAHLIEWKGWSKPSDSPAALESAFSSY
SDLSEGEQEARFAAGVAEQFAIAEAKLRAWSSVDGEDSTDDSYDEDFAGGMDTDMAGQLPLG
PHLQDLFTGHRFSRPVRQGSVEPESDCSQTVSPDTLCSSLCSLEDGLLGSPARLASQLLGDE
LLLAKLPPSRESAFRSLGPLEAQDSLYNSPLTESCLSPAEEEPAPCKDCQPLCPPLTGSWER
QRQASDLASSGVVSLDEDEAEPEEQ

Signal peptide:
amino acids 1-15

Casein kinase II phosphorylation site.
amino acids 123-127, 128-132, 155-159, 162-166, 166-170, 228-232, 285-289, 324-328

Tyrosine kinase phosphorylation site.
amino acids 44-52

N-myristoylation site.
amino acids 17-23, 26-32, 173-179

Prokaryotic membrane lipoprotein lipid attachment site.
amino acids 11-22

FIGURE 23

```
GGTTCCTGGGCGCTCTGTTACACAAGCAAGATACAGCCAGCCCCACCTAATTTTGTTTCCCT
GGCACCCTCCTGCTCAGTGCGACATTGTCACACTTAACCCATCTGTTTTCTCTAATGCACGA
CAGATTCCTTTCAGACAGGACAACTGTGATATTTCAGTTCCTGATTGTAAATACCTCCTAAG
CCTGAAGCTTCTGTTACTAGCCATTGTGAGCTTCAGTTTCTTCATCTGCAAAATGGGCATAA
TACAATCTATTCTTGCCACATCAAGGGATTGTTATTCCTTTAAAAAAAAACCAATACCAAAG
AAGCCTACAATGTTGGCCTTAGCCAAAATTCTGTTGATTTCAACGTTGTTTTATTCACTTCT
ATCGGGGAGCCATGGAAAAGAAAATCAAGACATAAACACAACACAGAACATTGCAGAAGTTT
TTAAAACAATGGAAAATAAACCTATTTCTTTGGAAAGTGAAGCAAACTTAAACTCAGATAAA
GAAAATATAACCACCTCAAATCTCAAGGCGAGTCATTCCCCTCCTTTGAATCTACCCAACAA
CAGCCACGGAATAACAGATTTCTCCAGTAACTCATCAGCAGAGCATTCTTTGGGCAGTCTAA
AACCCACATCTACCATTTCCACAAGCCCTCCCTTGATCCATAGCTTTGTTTCTAAAGTGCCT
TGGAATGCACCTATAGCAGATGAAGATCTTTTGCCCATCTCAGCACATCCCAATGCTACACC
TGCTCTGTCTTCAGAAAACTTCACTTGGTCTTTGGTCAATGACACCGTGAAAACTCCTGATA
ACAGTTCCATTACAGTTAGCATCCTCTCTTCAGAACCAACTTCTCCATCTGTGACCCCCTTG
ATAGTGGAACCAAGTGGATGGCTTACCACAAACAGTGATAGCTTCACTGGGTTTACCCCTTA
TCAAGAAAAAACAACTCTACAGCCTACCTTAAAATTCACCAATAATTCAAAACTCTTTCCAA
ATACGTCAGATCCCCAAAAAGAAAATAGAAATACAGGAATAGTATTCGGGGCCATTTTAGGT
GCTATTCTGGGTGTCTCATTGCTTACTCTTGTGGGCTACTTGTTGTGTGGAAAAAGGAAAAC
GGATTCATTTTCCCATCGGCGACTTTATGACGACAGAAATGAACCAGTTCTGCGATTAGACA
ATGCACCGGAACCTTATGATGTGAGTTTTGGGAATTCTAGCTACTACAATCCAACTTTGAAT
GATTCAGCCATGCCAGAAAGTGAAGAAAATGCACGTGATGGCATTCCTATGGATGACATACC
TCCACTTCGTACTTCTGTATAGAACTAACAGCAAAAAGGCGTTAAACAGCAAGTGTCATCTA
CATCCTAGCCTTTTGACAAATTCATCTTTCAAAAGGTTACACAAAATTACTGTCACGTGGAT
TTTGTCAAGGAGAATCATAAAAGCAGGAGACCAGTAGCAGAAATGTAGACAGGATGTATCAT
CCAAAGGTTTTCTTTCTTACAATTTTTGGCCATCCTGAGGCATTTACTAAGTAGCCTTAATT
TGTATTTTAGTAGTATTTTCTTAGTAGAAAATATTTGTGGAATCAGATAAAACTAAAAGATT
TCACCATTACAGCCCTGCCTCATAACTAAATAATAAAAATTATTCCACCAAAAAATTCTAAA
ACAATGAAGATGACTCTTTACTGCTCTGCCTGAAGCCCTAGTACCATAATTCAAGATTGCAT
TTTCTTAAATGAAAATTGAAGGGTGCTTTTTAAAGAAAATTTGACTTAAAGCTAAAAAGAG
GACATAGCCCAGAGTTTCTGTTATTGGGAAATTGAGGCAATAGAAATGACAGACCTGTATTC
TAGTACGTTATAATTTTCTAGATCAGCACACACATGATCAGCCCACTGAGTTATGAAGCTGA
CAATGACTGCATTCAACGGGGCCATGGCAGGAAAGCTGACCCTACCCAGGAAAGTAATAGCT
TCTTTAAAAGTCTTCAAAGGTTTTGGGAATTTTAACTTGTCTTAATATATCTTAGGCTTCAA
TTATTTGGGTGCCTTAAAAACTCAATGAGAATCATGGT
```

FIGURE 24

```
></usr/seqdb2/sst/DNA/Dnaseqs.min/ss.DNA58732
><subunit 1 of 1, 334 aa, 1 stop
><MW: 36294, pI: 4.98, NX(S/T): 13
MLALAKILLISTLFYSLLSGSHGKENQDINTTQNIAEVFKTMENKPISLESEANLNSDKENI
TTSNLKASHSPPLNLPNNSHGITDFSSNSSAEHSLGSLKPTSTISTSPPLIHSFVSKVPWNA
PIADEDLLPISAHPNATPALSSENFTWSLVNDTVKTPDNSSITVSILSSEPTSPSVTPLIVE
PSGWLTTNSDSFTGFTPYQEKTTLQPTLKFTNNSKLFPNTSDPQKENRNTGIVFGAILGAIL
GVSLLTLVGYLLCGKRKTDSFSHRRLYDDRNEPVLRLDNAPEPYDVSFGNSSYYNPTLNDSA
MPESEENARDGIPMDDIPPLRTSV
```

Signal peptide:

amino acids 1-23

Transmembrane domain:

amino acids 235-262

N-glycosylation site.

amino acids 30-34, 61-65, 79-83, 90-94, 148-152, 155-159, 163-167, 218-222, 225-229, 298-302, 307-311

FIGURE 25

```
AACAGGATCTCCTCTTGCAGTCTGCAGCCCAGGACGCTGATTCCAGCAGCGCCTTACCGCGC
AGCCCGAAGATTCACTATGGTGAAAATCGCCTTCAATACCCCTACCGCCGTGCAAAAGGAGG
AGGCGCGGCAAGACGTGGAGGCCCTCCTGAGCCGCACGGTCAGAACTCAGATACTGACCGGC
AAGGAGCTCCGAGTTGCCACCCAGGAAAAGAGGGCTCCTCTGGGAGATGTATGCTTACTCT
CTTAGGCCTTTCATTCATCTTGGCAGGACTTATTGTTGGTGGAGCCTGCATTTACAAGTACT
TCATGCCCAAGAGCACCATTTACCGTGGAGAGATGTGCTTTTTTGATTCTGAGGATCCTGCA
AATTCCCTTCGTGGAGGAGAGCCTAACTTCCTGCCTGTGACTGAGGAGGCTGACATTCGTGA
GGATGACAACATTGCAATCATTGATGTGCCTGTCCCCAGTTTCTCTGATAGTGACCCTGCAG
CAATTATTCATGACTTTGAAAAGGGAATGACTGCTTACCTGGACTTGTTGCTGGGGAACTGC
TATCTGATGCCCCTCAATACTTCTATTGTTATGCCTCCAAAAAATCTGGTAGAGCTCTTTGG
CAAACTGGCGAGTGGCAGATATCTGCCTCAAACTTATGTGGTTCGAGAAGACCTAGTTGCTG
TGGAGGAAATTCGTGATGTTAGTAACCTTGGCATCTTTATTTACCAACTTTGCAATAACAGA
AAGTCCTTCCGCCTTCGTCGCAGAGACCTCTTGCTGGGTTTCAACAAACGTGCCATTGATAA
ATGCTGGAAGATTAGACACTTCCCCAACGAATTTATTGTTGAGACCAAGATCTGTCAAGAGT
AAGAGGCAACAGATAGAGTGTCCTTGGTAATAAGAAGTCAGAGATTTACAATATGACTTTAA
CATTAAGGTTTATGGGATACTCAAGATATTTACTCATGCATTTACTCTATTGCTTATGCTTT
AAAAAAAGGAAAAAAAAAAAAACTACTAACCACTGCAAGCTCTTGTCAAATTTTAGTTTAAT
TGGCATTGCTTGTTTTTGAAACTGAAATTACATGAGTTTCATTTTTTCTTTGCATTTATAG
GGTTTAGATTTCTGAAAGCAGCATGAATATATCACCTAACATCCTGACAATAAATTCCATCC
GTTGTTTTTTTTGTTTGTTTGTTTTTTCTTTTCCTTTAAGTAAGCTCTTTATTCATCTTATG
GTGGAGCAATTTTAAAATTTGAAATATTTTAAATTGTTTTGAACTTTTTGTGTAAAATATA
TCAGATCTCAACATTGTTGGTTTCTTTTGTTTTTCATTTGTACAACTTTCTTGAATTTAGA
AATTACATCTTTGCAGTTCTGTTAGGTGCTCTGTAATTAACCTGACTTATATGTGAACAATT
TTCATGAGACAGTCATTTTTAACTAATGCAGTGATTCTTTCTCACTACTATCTGTATTGTGG
AATGCACAAAATTGTGTAGGTGCTGAATGCTGTAAGGAGTTTAGGTTGTATGAATTCTACAA
CCCTATAATAAATTTTACTCTATACAAAAAAAAAAAAAAAAAA
```

FIGURE 26

```
</usr/seqdb2/sst/DNA/Dnaseqs.min/ss.DNA58828
<subunit 1 of 1, 263 aa, 1 stop
<MW: 29741, pI: 5.74, NX(S/T): 1
MVKIAFNTPTAVQKEEARQDVEALLSRTVRTQILTGKELRVATQEKEGSSGRCMLTLLGLSF
ILAGLIVGGACIYKYFMPKSTIYRGEMCFFDSEDPANSLRGGEPNFLPVTEEADIREDDNIA
IIDVPVPSFSDSDPAAIIHDFEKGMTAYLDLLLGNCYLMPLNTSIVMPPKNLVELFGKLASG
RYLPQTYVVREDLVAVEEIRDVSNLGIFIYQLCNNRKSFRLRRRDLLLGFNKRAIDKCWKIR
HFPNEFIVETKICQE
```

Type II transmembrane domain:

amino acids 53-75

N-glycosylation site.

amino acids 166-170

Casein kinase II phosphorylation site.

amino acids 35-39, 132-136, 134-138

N-myristoylation site amino acids 66-72, 103-109

Prokaryotic membrane lipoprotein lipid attachment site.

amino acids 63-74

FIGURE 27

```
GGAGGAGGGAGGGCGGGCAGGCGCCAGCCCAGAGCAGCCCCGGGCACCAGCACGGACTCTCT
CTTCCAGCCCAGGTGCCCCCCACTCTCGCTCCATTCGGCGGGAGCACCCAGTCCTGTACGCC
AAGGAACTGGTCCTGGGGGCACCATGGTTTCGGCGGCAGCCCCCAGCCTCCTCATCCTTCTG
TTGCTGCTGCTGGGGTCTGTGCCTGCTACCGACGCCCGCTCTGTGCCCCTGAAGGCCACGTT
CCTGGAGGATGTGGCGGGTAGTGGGGAGGCCGAGGGCTCGTCGGCCTCCTCCCCGAGCCTCC
CGCCACCCTGGACCCCGGCCCTCAGCCCCACATCGATGGGGCCCCAGCCCACAACCCTGGGG
GGCCCATCACCCCCCACCAACTTCCTGGATGGGATAGTGGACTTCTTCCGCCAGTACGTGAT
GCTGATTGCTGTGGTGGGCTCCCTGGCCTTTCTGCTGATGTTCATCGTCTGTGCCGCGGTCA
TCACCCGGCAGAAGCAGAAGGCCTCGGCCTATTACCCATCGTCCTTCCCCAAGAAGAAGTAC
GTGGACCAGAGTGACCGGGCCGGGGGCCCCCGGGCCTTCAGTGAGGTCCCCGACAGAGCCCC
CGACAGCAGGCCCGAGGAAGCCCTGGATTCCTCCCGGCAGCTCCAGGCCGACATCTTGGCCG
CCACCCAGAACCTCAAGTCCCCCACCAGGGCTGCACTGGGCGGTGGGGACGGAGCCAGGATG
GTGGAGGGCAGGGGCGCAGAGGAAGAGGAGAAGGGCAGCCAGGAGGGGGACCAGGAAGTCCA
GGGACATGGGGTCCCAGTGGAGACACCAGAGGCGCAGGAGGAGCCGTGCTCAGGGGTCCTTG
AGGGGGCTGTGGTGGCCGGTGAGGGCCAAGGGGAGCTGGAAGGGTCTCTCTTGTTAGCCCAG
GAAGCCCAGGGACCAGTGGGTCCCCCCGAAAGCCCCTGTGCTTGCAGCAGTGTCCACCCCAG
TGTCTAACAGTCCTCCCGGGCTGCCAGCCCTGACTGTCGGGCCCCCAAGTGGTCACCTCCCC
GTGTATGAAAAGGCCTTCAGCCCTGACTGCTTCCTGACACTCCCTCCTTGGCCTCCCTGTGG
TGCCAATCCCAGCATGTGCTGATTCTACAGCAGGCAGAAATGCTGGTCCCCGGTGCCCCGGA
GGAATCTTACCAAGTGCCATCATCCTTCACCTCAGCAGCCCCAAAGGGCTACATCCTACAGC
ACAGCTCCCCTGACAAAGTGAGGGAGGGCACGTGTCCCTGTGACAGCCAGGATAAAACATCC
CCCAAAGTGCTGGGATTACAGGCGTGAGCCACCGTGCCCGGCCCAAACTACTTTTTAAAACA
GCTACAGGGTAAAATCCTGCAGCACCCACTCTGGAAAATACTGCTCTTAATTTTCCTGAAGG
TGGCCCCCTGTTTCTAGTTGGTCCAGGATTAGGGATGTGGGGTATAGGGCATTTAAATCCTC
TCAAGCGCTCTCCAAGCACCCCCGGCCTGGGGGTGAGTTTCTCATCCCGCTACTGCTGCTGG
GATCAGGTTGAATGAATGGAACTCTTCCTGTCTGGCCTCCAAAGCAGCCTAGAAGCTGAGGG
GCTGTGTTTGAGGGGACCTCCACCCTGGGGAAGTCCGAGGGGCTGGGGAAGGGTTTCTGACG
CCCAGCCTGGAGCAGGGGGGCCCTGGCCACCCCCTGTTGCTCACACATTGTCTGGCAGCCTG
TGTCCACAATATTCGTCAGTCCTCGACAGGGAGCCTGGGCTCCGTCCTGCTTTAGGGAGGCT
CTGGCAGGAGGTCCTCTCCCCCATCCCTCCATCTGGGGCTCCCCCAACCTCTGCACAGCTCT
CCAGGTGCTGAGATATAATGCACCAGCACAATAAACCTTTATTCCGGCCTGAAAAAAAAAAA
AAAAAAAAAAAAAAAAAAAAAAAAAAAAAAAAAAAAAAAAAGA
```

FIGURE 28

></usr/seqdb2/sst/DNA/Dnaseqs.min/ss.DNA58852
><subunit 1 of 1, 283 aa, 1 stop
><MW: 29191, pI: 4.52, NX(S/T): 0
MVSAAAPSLLILLLLLLGSVPATDARSVPLKATFLEDVAGSGEAEGSSASSPSLPPPWTPAL
SPTSMGPQPTTLGGPSPPTNFLDGIVDFFRQYVMLIAVVGSLAFLLMFIVCAAVITRQKQKA
SAYYPSSFPKKKYVDQSDRAGGPRAFSEVPDRAPDSRPEEALDSSRQLQADILAATQNLKSP
TRAALGGGDGARMVEGRGAEEEEKGSQEGDQEVQGHGVPVETPEAQEEPCSGVLEGAVVAGE
GQGELEGSLLLAQEAQGPVGPPESPCACSSVHPSV

Signal peptide:
amino acids 1-25

Transmembrane domain:
amino acids 94-118

N-myristoylation site.
amino acids 18-24, 40-46, 46-52, 145-151, 192-198, 193-199, 211-217, 238-244, 242-248

FIGURE 29

```
GTGGACTCTGAGAAGCCCAGGCAGTTGAGGACAGGAGAGAGAAGGCTGCAGACCCAGAGGGA
GGGAGGACAGGGAGTCGGAAGGAGGAGGACAGAGGAGGGCACAGAGACGCAGAGCAAGGGCG
GCAAGGAGGAGACCCTGGTGGGAGGAAGACACTCTGGAGAGAGAGGGGGCTGGGCAGAGATG
AAGTTCCAGGGGCCCCTGGCCTGCCTCCTGCTGGCCCTCTGCCTGGGCAGTGGGGAGGCTGG
CCCCCTGCAGAGCGGAGAGGAAAGCACTGGGACAAATATTGGGGAGGCCCTTGGACATGGCC
TGGGAGACGCCCTGAGCGAAGGGGTGGGAAAGGCCATTGGCAAAGAGGCCGGAGGGGCAGCT
GGCTCTAAAGTCAGTGAGGCCCTTGGCCAAGGGACCAGAGAAGCAGTTGGCACTGGAGTCAG
GCAGGTTCCAGGCTTTGGCGCAGCAGATGCTTTGGGCAACAGGGTCGGGGAAGCAGCCCATG
CTCTGGGAAACACTGGGCACGAGATTGGCAGACAGGCAGAAGATGTCATTCGACACGGAGCA
GATGCTGTCCGCGGCTCCTGGCAGGGGTGCCTGGCCACAGTGGTGCTTGGGAAACTTCTGG
AGGCCATGGCATCTTTGGCTCTCAAGGTGGCCTTGGAGGCCAGGGCCAGGGCAATCCTGGAG
GTCTGGGGACTCCGTGGGTCCACGGATACCCCGGAAACTCAGCAGGCAGCTTTGGAATGAAT
CCTCAGGGAGCTCCCTGGGGTCAAGGAGGCAATGGAGGGCCACCAAACTTTGGGACCAACAC
TCAGGGAGCTGTGGCCCAGCCTGGCTATGGTTCAGTGAGAGCCAGCAACCAGAATGAAGGGT
GCACGAATCCCCCACCATCTGGCTCAGGTGGAGGCTCCAGCAACTCTGGGGGAGGCAGCGGC
TCACAGTCGGGCAGCAGTGGCAGTGGCAGCAATGGTGACAACAACAATGGCAGCAGCAGTGG
TGGCAGCAGCAGTGGCAGCAGCAGTGGCAGCAGCAGTGGCGGCAGCAGTGGCGGCAGCAGTG
GTGGCAGCAGTGGCAACAGTGGTGGCAGCAGAGGTGACAGCGGCAGTGAGTCCTCCTGGGGA
TCCAGCACCGGCTCCTCCTCCGGCAACCACGGTGGGAGCGGCGGAGGAAATGGACATAAACC
CGGGTGTGAAAAGCCAGGGAATGAAGCCCGCGGGAGCGGGGAATCTGGGATTCAGGGCTTCA
GAGGACAGGGAGTTTCCAGCAACATGAGGGAAATAAGCAAAGAGGGCAATCGCCTCCTTGGA
GGCTCTGGAGACAATTATCGGGGGCAAGGGTCGAGCTGGGGCAGTGGAGGAGGTGACGCTGT
TGGTGGAGTCAATACTGTGAACTCTGAGACGTCTCCTGGGATGTTTAACTTTGACACTTTCT
GGAAGAATTTTAAATCCAAGCTGGGTTTCATCAACTGGGATGCCATAAACAAGGACCAGAGA
AGCTCTCGCATCCCGTGACCTCCAGACAAGGAGCCACCAGATTGGATGGGAGCCCCCACACT
CCCTCCTTAAAACACCACCCTCTCATCACTAATCTCAGCCCTTGCCCTTGAAATAAACCTTA
GCTGCCCCACAAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAA
```

FIGURE 30

```
></usr/seqdb2/sst/DNA/Dnaseqs.min/ss.DNA59212
><subunit 1 of 1, 440 aa, 1 stop
><MW: 42208, pI: 6.36, NX(S/T): 1
MKFQGPLACLLLALCLGSGEAGPLQSGEESTGTNIGEALGHGLGDALSEGVGKAIGKEAGGA
AGSKVSEALGQGTREAVGTGVRQVPGFGAADALGNRVGEAAHALGNTGHEIGRQAEDVIRHG
ADAVRGSWQGVPGHSGAWETSGGHGIFGSQGGLGGQGQGNPGGLGTPWVHGYPGNSAGSFGM
NPQGAPWGQGGNGGPPNFGTNTQGAVAQPGYGSVRASNQNEGCTNPPPSGSGGGSSNSGGGS
GSQSGSSGSGSNGDNNNGSSSGGSSSGSSSGSSSGGSSGGSSGGSSGNSGGSRGDSGSESSW
GSSTGSSSGNHGGSGGGNGHKPGCEKPGNEARGSGESGIQGFRGQGVSSNMREISKEGNRLL
GGSGDNYRGQGSSWGSGGGDAVGGVNTVNSETSPGMFNFDTFWKNFKSKLGFINWDAINKDQ
RSSRIP
```

Signal peptide:
amino acids 1-21
N-glycosylation site.
amino acids 265-269
Glycosaminoglycan attachment site.
amino acids 235-239, 237-241, 244-248, 255-259, 324-328, 388-392
Casein kinase II phosphorylation site.
amino acids 26-30, 109-113, 259-263, 300-304, 304-308
N-myristoylation site.
amino acids 17-23, 32-38, 42-48, 50-56, 60-66, 61-67, 64-70,
74-80, 90-96, 96-102, 130-136, 140-146, 149-155, 152-158,
155-161, 159-165, 163-169, 178-184, 190-196, 194-200, 199-205,
218-224, 236-242, 238-244, 239-245, 240-246, 245-251, 246-252,
249-252, 253-259, 256-262, 266-272, 270-276, 271-277, 275-281,
279-285, 283-289, 284-290, 287-293, 288-294, 291-297, 292-298,
295-301, 298-304, 305-311, 311-317, 315-321, 319-325, 322-328,
323-329, 325-331, 343-349, 354-360, 356-362, 374-380, 381-387,
383-389, 387-393, 389-395, 395-401
Cell attachment sequence.
amino acids 301-304

FIGURE 31

```
GACCGGTCCCTCCGGTCCTGGATGTGCGGACTCTGCTGCAGCGAGGGCTGCAGGCCCGCCGGGCGGTGCTCACCG
TGCCCTGGCTGGTGGAGTTTCTCTCCTTTGCTGACCATGTTGTTCCCTTGCTGGAATATTACCGGGACATCTTCA
CTCTCCTGCTGCGCCTGCACCGGAGCTTGGTGTTGTCGCAGGAGAGTGAGGGGAAGATGTGTTTCCTGAACAAGC
TGCTGCTACTTGCTGTCCTGGGCTGGCTTTTCCAGATTCCCACAGTCCCTGAGGACTTGTTCTTTCTGGAAGAGG
GTCCCTCATATGCCTTTGAGGTGGACACAGTAGCCCCAGAGCATGGCTTGGACAATGCGCCTGTGGTGGACCAGC
AGCTGCTCTACACCTGCTGCCCCTACATCGGAGAGCTCCGGAAACTGCTCGCTTCGTGGGTGTCAGGCAGTAGTG
GACGGAGTGGGGGCTTCATGAGGAAAATCACCCCCACCACTACCACCAGCCTGGGAGCCCAGCCTTCCCAGACCA
GCCAGGGGCTGCAGGCACAGCTCGCCCAGGCCTTTTTCCACAACCAGCCGCCCTCCTTGCGCCGGACCGTAGAGT
TCGTGGCAGAAAGAATTGGATCAAACTGTGTCAAACATATCAAGGCTACACTGGTGGCAGATCTGGTGCGCCAGG
CAGAGTCACTTCTCCAAGAGCAGCTGGTGACACAGGGAGAGGAAGGGGGAGACCCAGCCCAGCTGTTGGAGATCT
TGTGTTCCCAGCTGTGCCCTCACGGGGCCCAGGCATTGGCCCTGGGGCGGGAGTTCTGTCAAAGGAAGAGCCCTG
GGGCTGTGCGGGCGCTGCTTCCAGAGGAGACCCCGGCAGCCGTTCTGAGCAGTGCAGAGAACATTGCTGTGGGGC
TTGCAACAGAGAAAGCCTGTGCTTGGCTGTCAGCCAACATCACAGCACTGATCAGGAGGGAGGTGAAAGCAGCAG
TGAGTCGCACACTTCGAGCCCAGGGTCCTGAACCTGCTGCCCGGGGGGAGCGGAGGGGCTGCTCCCGCGCCTGAC
GTGCTCTCCTTGGCCGTGGGGCCACGGGACCCTGACGAGGGAGTCTCCCCAGAGCATCTGGAACAGCTCCTAGGC
CAGCTGGGCCAGACGCTGCGGTGCCGCCAGTTCCTGTGCCCACCTGCTGAGCAGCATCTGGCAAAGTGCTCTGTG
GAGTTAGCTTCCCTCCTCGTTGCAGATCAAATTCCTATCCTAGGGCCCCCGGCACAGTACAGGCTGGAGAGAGGG
CAGGCTCGAAGGCTTCTGCACATGCTGCTTTCCTTGTGGAAGGAAGACTTTCAGGGGCCGGTTCCGCTGCAGCTG
CTGCTGAGCCCAAGAAATGTGGGGCTTCTGGCAGACACAAGGCCAAGGGAGTGGGACTTGCTGCTATTCTTGCTA
CGGGAGCTGGTGGAGAAGGGTCTGATGGGACGGATGGAGATAGAGGCCTGCCTGGGCAGCCTCCACCAGGCCCAG
TGGCCAGGGGACTTTGCTGAAGAATTAGCAACACTGTCTAATCTGTTTCTAGCCGAGCCCCACCTGCCAGAACCC
CAGCTAAGAGCCTGTGAGTTGGTGCAGCCAAACCGGGGCACTGTGCTGGCCCAGAGCTAGGGCTGAGAAGTGGCC
CTGCCTTGGGCATTGCACCAGAACCCTGGACCCCCGCCTCACGAGGAGGCCCAAGTGCCCAATGCAGACCCTCAC
TGGTTGGGGTGTAGCTGGGTCTACAGTCAGACTTCCTGCTCTAAGGGTGTCACTGCCTGGCATCCCACCACGCGA
ATCCTAGAGGAAGGAGAGTTGGCCTGATTTGGGATTATGGCAGAAAAGTCCAGAGATGCCAGTCCTGGAGTAGAA
GAGGTGGTGTTTGTTTATCTCTTGGATACTAAATGAAATGAGGTGTGTGGGCTTGTCAACACAGAATTCAAGCCT
CATTTGCTATCCCAGCATCTCTTAAAACTTTGTAGTCTTGGAATTCATGACAGAGGCAAATGACTCCTGCTTAAC
TTATGAAGAAAGTTAAAACATGAATCTTGGGAGTCTACATTTTCTTATCACCAGGAGCTGGACTGCCATCTCCTT
ATAAATGCCTAACACAGGCCGGGTCTGGTGGCTCATGCCTGTAATCCCAGCACTTTGAGAGGCCTGAGGTCGGCG
GACTGCCTGAGGTCAGGAATTCAAGACCAGCCTGGCCAACATGGCAAAACCCCATCTCTACTAAAAATAAAAAAA
TTATTAGCTGGGCATGGTGGTGTGTGCCTGTAATCCCAGCTACTCAGGAGGATGAGGCAGGAGACCTGCTTGAAC
CTGGAGGTGGAGGTTGCAGTGAGCCGAGGTCGCACCACTGCACTCCAGTCTGGGTAACAGAGCGAGACTTTCTAG
AAAAAGCCTAACAAACAGATAAGGTAGGACTCAACCAACTGAAACCTGACTTTCCCCCTGTACCTTCAGCCCCTG
TGCAGGTAGTAACCTCTTGAGACCTCTCCCTGACCAGGGACCAAGCACAGGGCATTTAGAGCTTTTTAGAATAAA
CTGGTTTTCTTTAAAAAAAAAAAAAAAAAAGGGCGGCCGCCCTTTTTTTTTTTTTTTTTTTTTTTTTTTTTTTT
TTTTTTTTTTTTTTTAAAAAGGGCTTTTATTAAAATTCTCCCCACACGATGGCTCCTGCAATCTGCCACAGCTC
TGGGGCGTGTCCTGTAGGGAAAGGCCCTGTTTTCCCTGAGGCGGGGCTGGGCTTGTCCATGGGTCCGCGGAGCTG
GCCGTGCTTGGCGCCCTGGCGTGTGTCTAGCTGCTTCTTGCCGGGCACAGAGCTGCGGGGTCTGGGGCACCGGG
AGCTAAGAGCAGGCTCTGGTGCAGGGGTGGAGGCCTGTCTCTTAACCGACACCCTGAGGTGCTCCTGAGATGCTG
GGTCCACCCTGAGTGGCACGGGGAGCAGCTGTGGCCGGTGCTCCTTCYTAGGCCAGTCCTGGGGAAACTAAGCTC
GGGCCCTTCTTTGCAAAGACCGAGGATGGGGTGGGTGTGGGGACTCATGGGGAATGCCTGAGGAGCTACGTGT
GAAGAGGGCGCCGGTTTGTTGGCTGCAGCGGCCTGGAGCGCCTCTCTCCTGAGCCTCAGTTTCCCTTTCCGTCTA
ATGAAGAACATGCCGTCTCGGTGTCTCAGGGCTATTAGGACTTGCCCTCAGGAAGTGGCCTTGGACGAGCGTCAT
GTTATTTTCACAACTGTCCTGCGACGTTGGCCTGGGCACGTCATGGAATGGCCCATGTCCCTCTGCTGCGTGGAC
GTCGCGGTCGGGAGTGCGCAGCCAGAGGCGGGGCCAGACGTGCGCCTGGGGTGAGGGGAGGCGCCCGGGAGGG
CCTCACAGGAAGTTGGGCTCCCGCACCACCAGGCAGGGCGGGCTCCCGCCGCCGCCGCCACCACCGTCCAGG
GGCCGGTAGACAAAGTGGAAGTCGCGCTTGGGCTCGCTGCGCAGCAGGTAGCCCTTGATGCAGTGCGGCAGCGCG
TCGTCCGCCAGCTGGAAGCAGCGCCCGTCCACCAGCACGAACAGCCGGTGCGCCT
```

FIGURE 32

MCFLNKLLLLAVLGWLFQIPTVPEDLFFLEEGPSYAFEVDTVAPEHGLDNAPVVDQQLLYTC
CPYIGELRKLLASWVSGSSGRSGGFMRKITPTTTTSLGAQPSQTSQGLQAQLAQAFFHNQPP
SLRRTVEFVAERIGSNCVKHIKATLVADLVRQAESLLQEQLVTQGEEGGDPAQLLEILCSQL
CPHGAQALALGREFCQRKSPGAVRALLPEETPAAVLSSAENIAVGLATEKACAWLSANITAL
IRREVKAAVSRTLRAQGPEPAARGERRGCSRA

Signal peptide:

amino acids 1-18

N-glycosylation site.

amino acids 244-248 cAMP- and cGMP-dependent protein kinase phosphorylation site.

amino acids 89-93

Casein kinase II phosphorylation site.

amino acids 21-25, 167-171, 223-227

N-myristoylation site.

amino acids 100-106, 172-178, 207-213

Microbodies C-terminal targeting signal.

amino acids 278-282

FIGURE 33

```
TCCCTTGACAGGTCTGGTGGCTGGTTCGGGGTCTACTGAAGGCTGTCTTGATCAGGAAACTG
AAGACTCTCTGCTTTTGCCACAGCAGTTCCTGCAGCTTCCTTGAGGTGTGAACCCACATCCC
TGCCCCCAGGGCCACCTGCAGGACGCCGACACCTACCCCTCAGCAGACGCCGGAGAGAAATG
AGTAGCAACAAAGAGCAGCGGTCAGCAGTGTTCGTGATCCTCTTTGCCCTCATCACCATCCT
CATCCTCTACAGCTCCAACAGTGCCAATGAGGTCTTCCATTACGGCTCCCTGCGGGGCCGTA
GCCGCCGACCTGTCAACCTCAAGAAGTGGAGCATCACTGACGGCTATGTCCCATTCTCGGC
AACAAGACACTGCCCTCTCGGTGCCACCAGTGTGTGATTGTCAGCAGCTCCAGCCACCTGCT
GGGCACCAAGCTGGGCCCTGAGATCGAGCGGGCTGAGTGTACAATCCGCATGAATGATGCAC
CCACCACTGGCTACTCAGCTGATGTGGGCAACAAGACCACCTACCGCGTCGTGGCCCATTCC
AGTGTGTTCCGCGTGCTGAGGAGGCCCCAGGAGTTTGTCAACCGGACCCCTGAAACCGTGTT
CATCTTCTGGGGGCCCCGAGCAAGATGCAGAAGCCCCAGGGCAGCCTCGTGCGTGTGATCC
AGCGAGCGGGCCTGGTGTTCCCCAACATGGAAGCATATGCCGTCTCTCCCGGCCGCATGCGG
CAATTTGACGACCTCTTCCGGGGTGAGACGGGCAAGGACAGGGAGAAGTCTCATTCGTGGTT
GAGCACAGGCTGGTTTACCATGGTGATCGCGGTGGAGTTGTGTGACCACGTGCATGTCTATG
GCATGGTCCCCCCCAACTACTGCAGCCAGCGGCCCCGCCTCCAGCGCATGCCCTACCACTAC
TACGAGCCCAAGGGGCCGGACGAATGTGTCACCTACATCCAGAATGAGCACAGTCGCAAGGG
CAACCACCACCGCTTCATCACCGAGAAAGGGTCTTCTCATCGTGGGCCCAGCTGTATGGCA
TCACCTTCTCCCACCCCTCCTGGACCTAGGCCACCCAGCCTGTGGGACCTCAGGAGGGTCAG
AGGAGAAGCAGCCTCCGCCCAGCCGCTAGGCCAGGGACCATCTTCTGGCCAATCAAGGCTTG
CTGGAGTGTCTCCCAGCCAATCAGGGCCTTGAGGAGGATGTATCCTCCAGCCAATCAGGGCC
TGGGGAATCTGTTGGCGAATCAGGGATTTGGGAGTCTATGTGGTTAATCAGGGGTGTCTTTC
TTGTGCAGTCAGGGTCTGCGCACAGTCAATCAGGGTAGAGGGGGTATTTCTGAGTCAATCTG
AGGCTAAGGACATGTCCTTTCCCATGAGGCCTTGGTTCAGAGCCCCAGGAATGGACCCCCCA
ATCACTCCCCACTCTGCTGGGATAATGGGGTCCTGTCCCAAGGAGCTGGGAACTTGGTGTTG
CCCCCTCAATTTCCAGCACCAGAAAGAGAGATTGTGTGGGGTAGAAGCTGTCTGGAGGCCC
GGCCAGAGAATTTGTGGGGTTGTGGAGGTTGTGGGGCGGTGGGGAGGTCCCAGAGGTGGGA
GGCTGGCATCCAGGTCTTGGCTCTGCCCTGAGACCTTGGACAAACCCTTCCCCCTCTCTGGG
CACCCTTCTGCCCACACCAGTTTCCAGTGCGGAGTCTGAGACCCTTTCCACCTCCCCTACAA
GTGCCCTCGGGTCTGTCCTCCCGTCTGGACCCTCCCAGCCACTATCCCTTGCTGGAAGGCT
CAGCTCTTTGGGGGGTCTGGGTGACCTCCCCACCTCCTGGAAAACTTTAGGGTATTTTTGC
GCAAACTCCTTCAGGGTTGGGGACTCTGAAGGAAACGGGACAAAACCTTAAGCTGTTTTCT
TAGCCCCTCAGCCAGCTGCCATTAGCTTGGCTCTTAAAGGGCCAGGCCTCCTTTCTGCCCT
CTAGCAGGGAGGTTTTCCAACTGTTGGAGGCGCCTTTGGGCTGCCCCTTTGTCTGGAGTCA
CTGGGGGCTTCCGAGGGTCTCCCTCGACCCTCTGTCGTCCTGGGATGGCTGTCGGGAGCTGT
ATCACCTGGGTTCTGTCCCCTGGCTCTGTATCAGGCACTTTATTAAAGCTGGGCCTCAGTGG
GGTGTGTTTGTCTCCTGCTCTTCTGGAGCCTGGAAGGAAAGGGCTTCAGGAGGAGGCTGTGA
GGCTGGAGGGACCAGATGGAGGAGGCCAGCAGCTAGCCATTGCACACTGGGTGATGGGTGG
GGGCGGTGACTGCCCCAGACTTGGTTTTGTAATGATTTGTACAGGAATAAACACACCTACGC
TCCGGAAAAAAAAAAAAAAAAAAAAAAAAAAAAAAAAAAAAAAAAA
```

FIGURE 34

MSSNKEQRSAVFVILFALITILILYSSNSANEVFHYGSLRGRSRRPVNLKKWSITDGYVPIL
GNKTLPSRCHQCVIVSSSSHLLGTKLGPEIERAECTIRMNDAPTTGYSADVGNKTTYRVVAH
SSVFRVLRRPQEFVNRTPETVFIFWGPPSKMQKPQGSLVRVIQRAGLVFPNMEAYAVSPGRM
RQFDDLFRGETGKDREKSHSWLSTGWFTMVIAVELCDHVHVYGMVPPNYCSQRPRLQRMPYH
YYEPKGPDECVTYIQNEHSRKGNHHRFITEKRVFSSWAQLYGITFSHPSWT

Signal peptide:

amino acids 1-29

Transmembrane domain:

amino acids 9-31 (type II)

N-glycosylation site.

amino acids 64-68, 115-119 cAMP- and cGMP-dependent protein kinase phosphorylation site.

amino acids 50-54

Casein kinase II phosphorylation site.

amino acids 3-7, 29-33, 53-57, 197-201

Tyrosine kinase phosphorylation site.

amino acids 253-262

N-myristoylation site.

amino acids 37-43, 114-120, 290-294

FIGURE 35

```
GTTTCTCATAGTTGGCGTCTTCTAAAGGAAAAACACTAAAATGAGGAACTCAGCGGACCGGGAGCGACGCAGCTT
GAGGGAAGCATCCCTAGCTGTTGGCGCAGAGGGGCGAGGCTGAAGCCGAGTGGCCCGAGGTGTCTGAGGGGCTGG
GGCAAAGGTGAAAGAGTTTCAGAACAAGCTTCCTGGAACCCATGACCCATGAAGTCTTGTCGACATTTATACCGT
CTGAGGGTAGCAGCTCGAAACTAGAAGAAGTGGAGTGTTGCCAGGGACGGCAGTATCTCTTTGTGTGACCCTGGC
GGCCTATGGGACGTTGGCTTCAGACCTTTGTGATACACCATGCTGCGTGGGACGATGACGGCGTGGAGAGGAATG
AGGCCTGAGGTCACACTGGCTTGCCTCCTCCTAGCCACAGCAGGCTGCTTTGCTGACTTGAACGAGGTCCCTCAG
GTCACCGTCCAGCCTGCGTCCACCGTCCAGAAGCCCGGAGGCACTGTGATCTTGGGCTGCGTGGTGGAACCTCCA
AGGATGAATGTAACCTGGCGCCTGAATGGAAAGGAGCTGAATGGCTCGGATGATGCTCTGGGTGTCCTCATCACC
CACGGGACCCTCGTCATCACTGCCCTTAACAACCACACTGTGGGACGGTACCAGTGTGTGGCCCGGATGCCTGCG
GGGGCTGTGGCCAGCGTGCCAGCCACTGTGACACTAGCCAATCTCCAGGACTTCAAGTTAGATGTGCAGCACGTG
ATTGAAGTGGATGAGGGAAACACAGCAGTCATTGCCTGCCACCTGCCTGAGAGCCACCCCAAAGCCCAGGTCCGG
TACAGCGTCAAACAAGAGTGGCTGGAGGCCTCCAGAGGTAACTACCTGATCATGCCCTCAGGGAACCTCCAGATT
GTGAATGCCAGCCAGGAGGACGAGGGCATGTACAAGTGTGCAGCCTACAACCCAGTGACCCAGGAAGTGAAAACC
TCCGGCTCCAGCGACAGGCTACGTGTGCGCCGCTCCACCGCTGAGGCTGCCCGCATCATCTACCCCCCAGAGGCC
CAAACCATCATCGTCACCAAAGGCCAGAGTCTCATTCTGGAGTGTGTGGCCAGTGGAATCCCACCCCCACGGGTC
ACCTGGGCCAAGGATGGGTCCAGTGTCACCGGCTACAACAAGACGCGCTTCCTGCTGAGCAACCTCCTCATCGAC
ACCACCAGCGAGGAGGACTCAGGCACCTACCGCTGCATGGCCGACAATGGGGTTGGGCAGCCCGGGGCAGCGGTC
ATCCTCTACAATGTCCAGGTGTTTGAACCCCTGAGGTCACCATGGAGCTATCCCAGCTGGTCATCCCCTGGGGC
CAGAGTGCCAAGCTTACCTGTGAGGTGCGTGGGAACCCCCGCCCTCCGTGCTGTGGCTGAGGAATGCTGTGCCC
CTCATCTCCAGCCAGCGCCTCCGGCTCTCCCGCCAGGGCCCTGCGCTGTGCTCAGCATGGGGCCTGAGGACGAAGGC
GTCTACCAGTGCATGGCCGAGAACGAGGTTGGGAGCGCCCATGCCGTAGTCCAGCTGCGGACCTCCAGGCCAAGC
ATAACCCCAAGGCTATGGCAGGATGCTGAGCTGGCTACTGGCACACCTCCTGTATCACCCTCCAAACTCGGCAAC
CCTGAGCAGATGCTGAGGGGGCAACCGGCGCTCCCCAGACCCCCAACGTCAGTGGGGCCTGCTTCCCCGAAGTGT
CCAGGAGAGAAGGGGCAGGGGGCTCCCGCCGAGGGCTCCCATCATCCTCAGCTCGCCCCGCACCTCCAAGACAGAC
TCATATGAACTGGTGTGGCGGGCTCGGCATGAGGGCAGTGGCCGGGCGCCAATCCTCTACTATGTGGTGAAACAC
CGCAAGCAGGTCACAAATTCCTCTGACGATTGGACCATCTCTGGCATTCCAGCCAACCAGCACCGCCTGACCCTC
ACCAGACTTGACCCCGGGAGCTTGTATGAAGTGGAGATGGCAGCTTACAACTGTGCGGGAGAGGGCCAGACAGCC
ATGGTCACCTTCCGAACTGGACGGCGGCCCAAACCCGAGATCATGGCCAGCAAAGAGCAGCAGATCCAGAGAGAC
GACCCTGGAGCCAGTCCCCAGAGCAGCAGCCAGACCACGGCCGCCTCTCCCCCCCAGAAGCTCCCGACAGG
CCCACCATCTCCACGGCCTCCGAGACCTCAGTGTACGTGACCTGGATTCCCCGTGGGAATGGTGGGTTCCCAATC
CAGTCCTTCCGTGTGGAGTACAAGAAGCTAAAGAAAGTGGGAGACTGGATTCTGGCCACCAGCGCCATCCCCCCA
TCGCGGCTGTCCGTGGAGATCACGGGCCTAGAGAAAGGCACCTCCTACAAGTTTCGAGTCCGGGCTCTGAACATG
CTGGGGGAGAGCAGCCAGCCAGCCCCCTCTCGGCCCTACGTGGTGTCGGGCTACAGCGGGTCGCGTGTACGAGAGG
CCCGTGGCAGGTCCTTATATCACCTTCACGGATGCGGTCAATGAGACCACCATCATGCTCAAGTGGATGTACATC
CCAGCAAGTAACAACAACACCCCAATCCATGGCTTTTATATCTATTATCGACCCACAGACAGTGACAATGATAGT
GACTACAAGAAGGATATGGTGGAAGGGGACAAGTACTGGCACTCCATCAGCCACCTGCAGCCAGAGACCTCCTAC
GACATTAAGATGCAGTGCTTCAATGAAGGAGGGGAGAGCGAGTTCAGCAACGTGATGATCTGTGAGACCAAAGCT
CGGAAGTCTTCTGGCCAGCCTGGTCGACTGCCACCCCCAACTCTGGCCCCACCACAGCCGCCCCTTCCTGAAACC
ATAGAGCGGCCGGTGGGCACTGGGGCCATGGTGGCTCGCTCCAGCGACCTGCCCTATCTGATTGTCGGGGTCGTC
CTGGGCTCCATCGTTCTCATCATCGTCACCTTCATCCCCTTCTGCTTGTGGAGGGCCTGGTCTAAGCAAAAACAT
ACAACAGACCTGGGTTTTCCTCGAAGTGCCCTTCCACCCTCCTGCCCGTATACTATGGTGCCATTGGGAGGACTC
CCAGGCCACCAGGCCAGTGGACAGCCCTACCTCAGTGGCATCAGTGGACGGGCCTGTGCTAATGGGATCCACATG
AATAGGGGCTGCCCCTCGGCTGCAGTGGGCTACCCGGGCATGAAGCCCCAGCAGCACTGCCCAGGCGAGCTTCAG
CAGCAGAGTGACACCAGCAGCCTGCTGAGGCAGACCCATCTTGGCAATGGATATGACCCCCAAAGTCACCAGATC
ACGAGGGGTCCCAAGTCTAGCCCGGACGAGGGCTCTTTCTTATACACACTGCCCGACGACTCCACTCACCAGCTG
CTGCAGCCCCATCACGACTGCTGCCAACGCCAGGAGCAGCCTGCTGCTGTGGGCCAGTCAGGGGTGAGGAGACC
CCCGACAGTCCTGTCCTGGAAGCAGTGTGGGACCCTCCATTTCACTCAGGGCCCCCATGCTGCTTGGGCCTTGTG
CCAGTTGAAGAGGTGGACAGTCCTGACTCCTGCCAAGTGAGTGGAGGAGACTGGTGTCCCCAGCACCCCGTAGGG
GCCTACGTAGGACAGGAACCTGGAATGCAGCTCTCCCCGGGGCCACTGGTGCGTGTGTCTTTTGAAACACCACCT
CTCACAATTTAGGCAGAAGCTGATATCCCAGAAAGACTATATATTGTTTTTTTTTAAAAAAAAAAAGAAGAAAAA
AGAGACAGAGAAAATTGGTATTTATTTTTCTATTATAGCCATATTTATATATTTATGCACTTGTAAATAAATGTA
TATGTTTTATAATTCTGGAGAGACATAAGGAGTCCTACCCGTTGAGGTTGGAGAGGGAAAATAAAGAAGCTGCCA
CCTAACAGGAGTCACCCAGGAAAGCACCGCACAGGCTGGCGCGGGACAGACTCCTAACCTGGGGCCTCTGCAGTG
GCAGGCGAGGCTGCAGGAGGCCCACAGATAAGCTGGCAAGAGGAAGGATCCCAGGCACATGGTTCATCACGAGCA
TGAGGGAACAGCAAGGGGCACGGTATCACAGCCTGGAGACACCCACACAGATGGCTGGATCCGGTGCTACGGGAA
ACATTTTCCTAAGATGCCCATGAGAACAGACCAAGATGTGTACAGCACTATGAGCATTAAAAAACCTTCCAGAAT
CAATAATCCGTGGCAACATATCTCTGTAAAAACAAACACTGTAACTTCTAAATAAATGTTTAGTCTTCCCTGTAAAA
```

FIGURE 36

MLRGTMTAWRGMRPEVTLACLLLATAGCFADLNEVPQVTVQPASTVQKPGGTVILGCVVEPP
RMNVTWRLNGKELNGSDDALGVLITHGTLVITALNNHTVGRYQCVARMPAGAVASVPATVTL
ANLQDFKLDVQHVIEVDEGNTAVIACHLPESHPKAQVRYSVKQEWLEASRGNYLIMPSGNLQ
IVNASQEDEGMYKCAAYNPVTQEVKTSGSSDRLRVRRSTAEAARIIYPPEAQTIIVTKGQSL
ILECVASGIPPPRVTWAKDGSSVTGYNKTRFLLSNLLIDTTSEEDSGTYRCMADNGVGQPGA
AVILYNVQVFEPPEVTMELSQLVIPWGQSAKLTCEVRGNPPPSVLWLRNAVPLISSQRLRLS
RRALRVLSMGPEDEGVYQCMAENEVGSAHAVVQLRTSRPSITPRLWQDAELATGTPPVSPSK
LGNPEQMLRGQPALPRPPTSVGPASPKCPGEKGQGAPAEAPIILSSPRTSKTDSYELVWRPR
HEGSGRAPILYYVVKHRKQVTNSSDDWTISGIPANQHRLTLTRLDPGSLYEVEMAAYNCAGE
GQTAMVTFRTGRRPKPEIMASKEQQIQRDDPGASPQSSSQPDHGRLSPPEAPDRPTISTASE
TSVYVTWIPRGNGGFPIQSFRVEYKKLKKVGDWILATSAIPPSRLSVEITGLEKGTSYKFRV
RALNMLGESEPSAPSRPYVVSGYSGRVYERPVAGPYITFTDAVNETTIMLKWMYIPASNNNT
PIHGFYIYYRPTDSDNDSDYKKDMVEGDKYWHSISHLQPETSYDIKMQCFNEGGESEFSNVM
ICETKARKSSGQPGRLPPPTLAPPQPPLPETIERPVGTGAMVARSSDLPYLIVGVVLGSIVL
IIVTFIPFCLWRAWSKQKHTTDLGFPRSALPPSCPYTMVPLGGLPGHQASGQPYLSGISGRA
CANGIHMNRGCPSAAVGYPGMKPQQHCPGELQQQSDTSSLLRQTHLGNGYDPQSHQITRGPK
SSPDEGSFLYTLPDDSTHQLLQPHHDCCQRQEQPAAVGQSGVRRAPDSPVLEAVWDPPFHSG
PPCCLGLVPVEEVDSPDSCQVSGGDWCPQHPVGAYVGQEPGMQLSPGPLVRVSFETPPLTI

Signal peptide:
amino acids 1-30

Transmembrane domain:
amino acids 16-30 (type II), 854-879

FIGURE 37

CGGGAGGCTGGGTCGTCATGATCCGGACCCCATTGTCGGCCTCTGCCCATCGCCTGCTCCTC
CCAGGCTCCCGCGGCCGACCCCCGCGCAACATGCAGCCCACGGGCCGCGAGGGTTCCCGCGC
GCTCAGCCGGCGGTATCTGCGGCGTCTGCTGCTCCTGCTACTGCTGCTGCTGCGGCAGC
CCGTAACCCGCGCGGAGACCACGCCGGGCGCCCCAGAGCCCTCTCCACGCTGGGCTCCCCC
AGCCTCTTCACCACGCCGGGTGTCCCCAGCGCCCTCACTACCCCAGGCCTCACTACGCCAGG
CACCCCCAAAACCCTGGACCTTCGGGGTCGCGCGCAGGCCCTGATGCGGAGTTTCCCACTCG
TGGACGGCCACAATGACCTGCCCCAGGTCCTGAGACAGCGTTACAAGAATGTGCTTCAGGAT
GTTAACCTGCGAAATTTCAGCCATGGTCAGACCAGCCTGGACAGGCTTAGAGACGGCCTCGT
GGGTGCCCAGTTCTGGTCAGCCTCCGTCTCATGCCAGTCCCAGGACCAGACTGCCGTGCGCC
TCGCCCTGGAGCAGATTGACCTCATTCACCGCATGTGTGCCTCCTACTCTGAACTCGAGCTT
GTGACCTCAGCTGAAGGTCTGAACAGCTCTCAAAAGCTGGCCTGCCTCATTGGCGTGNAGGG
TGGTCACTCACTGGACAGCAGCCTCTCTGTGCTGCGCAGTTTCTATGTGCTGGGGGTGCGCT
ACCTGACACTTACCTTCACCTGCAGTACACCATGGGCAGAGAGTTCCACCAAGTTCAGACAC
CACATGTACACCAACGTCAGCGGATTGACAAGCTTTGGTGAGAAAGTAGTAGAGGAGTTGAA
CCGCCTGGGCATGATGATAGATTTGTCCTATGCATCGGACACCTTGATAAGAAGGGTCCTGG
AAGTGTCTCAGGCTCCTGTGATCTTCTCCCACTCAGCTGCCAGAGCTGTGTGTGACAATTTG
TTGAATGTTCCCGATGATATCCTGCAGCTTCTGAAGAACGGTGGCATCGTGATGGTGACACT
GTCCATGGGGGTGCTGCAGTGCAACCTGCTTGCTAACGTGTCCACTGTGGCAGATCACTTTG
ACCACATCAGGGCAGTCATTGGATCTGAGTTCATCGGGATTGGTGGAAATTATGACGGGACT
GGCCGGTTCCCTCAGGGGCTGGAGGATGTGTCCACATACCCAGTCCTGATAGAGGAGTTGCT
GAGTCGTASCTGGAGCGAGGAAGAGCTTCAAGGTGTCCTTCGTGGAAACCTGCTGCGGGTCT
TCAGACAAGTGGAAAAGGTGAGAGAGGAGAGCAGGGCGCAGAGCCCCGTGGAGGCTGAGTTT
CCATATGGGCAACTGAGCACATCCTGCCACTCCCACCTCGTGCCTCAGAATGGACACCAGGC
TACTCATCTGGAGGTGACCAAGCAGCCAACCAATCGGGTCCCCTGGAGGTCCTCAAATGCCT
CCCCATACCTTGTTCCAGGCCTTGTGGCTGCTGCCACCATCCCAACCTTCACCCAGTGGCTC
TGCTGACACAGTCGGTCCCCGCAGAGGTCACTGTGGCAAAGCCTCACAAAGCCCCTCTCCT
AGTTCATTCACAAGCATATGCTGAGAATAAACATGTTACACATGGAAAA

FIGURE 38

```
></usr/seqdb2/sst/DNA/Dnaseqs.min/ss.DNA59817
><subunit 1 of 1, 487 aa, 1 stop, 2 unknown
><MW: 53569.32, pI: 7.68, NX(S/T): 5
MQPTGREGSRALSRRYLRRLLLLLLLLLLRQPVTRAETTPGAPRALSTLGSPSLFTTPGVPS
ALTTPGLTTPGTPKTLDLRGRAQALMRSFPLVDGHNDLPQVLRQRYKNVLQDVNLRNFSHGQ
TSLDRLRDGLVGAQFWSASVSCQSQDQTAVRLALEQIDLIHRMCASYSELELVTSAEGLNSS
QKLACLIGVXGGHSLDSSLSVLRSFYVLGVRYLTLTFTCSTPWAESSTKFRHHMYTNVSGLT
SFGEKVVEELNRLGMMIDLSYASDTLIRRVLEVSQAPVIFSHSAARAVCDNLLNVPDDILQL
LKNGGIVMVTLSMGVLQCNLLANVSTVADHFDHIRAVIGSEFIGIGGNYDGTGRFPQGLEDV
STYPVLIEELLSRXWSEEELQGVLRGNLLRVFRQVEKVREESRAQSPVEAEFPYGQLSTSCH
SHLVPQNGHQATHLEVTKQPTNRVPWRSSNASPYLVPGLVAAATIPTFTQWLC
```

Important features of the protein:

Signal peptide:

amino acids 1-36

Transmembrane domain:

amino acids 313-331

N-glycosylation sites.

amino acids 119-122, 184-187, 243-246 and 333-336

N-myristoylation sites.

amino acids 41-46, 59-64, 73-78, 133-138, 182-187, 194-199, 324-329, 354-359, 357-362, 394-399, 427-432 and 472-477.

Prokaryotic membrane lipoprotein lipid attachment site.

amino acids 136-146

FIGURE 39

```
TGCTAGGCTCTGTCCCACAATGCACCCGAGAGCAGGAGCTGAAAGCCTCTAACACCCACAGA
TCCCTCTATGACTGCAATGTGAGGTGTCCGGCTTTGCTGGCCCAGCAAGCCTGATAAGCATG
AAGCTCTTATCTTTGGTGGCTGTGGTCGGGTGTTTGCTGGTGCCCCCAGCTGAAGCCAACAA
GAGTTCTGAAGATATCCGGTGCAAATGCATCTGTCCACCTTATAGAAACATCAGTGGGCACA
TTTACAACCAGAATGTATCCCAGAAGGACTGCAACTGCCTGCACGTGGTGGAGCCCATGCCA
GTGCCTGGCCATGACGTGGAGGCCTACTGCCTGCTGTGCGAGTGCAGGTACGAGGAGCGCAG
CACCACCACCATCAAGGTCATCATTGTCATCTACCTGTCCGTGGTGGGTGCCCTGTTGCTCT
ACATGGCCTTCCTGATGCTGGTGGACCCTCTGATCCGAAAGCCGGATGCATACACTGAGCAA
CTGCACAATGAGGAGGAGAATGAGGATGCTCGCTCTATGGCAGCAGCTGCTGCATCCCTCGG
GGGACCCCGAGCAAACACAGTCCTGGAGCGTGTGGAAGGTGCCCAGCAGCGGTGGAAGCTGC
AGGTGCAGGAGCAGCGGAAGACAGTCTTCGATCGGCACAAGATGCTCAGCTAGATGGGCTGG
TGTGGTTGGGTCAAGGCCCCAACACCATGGCTGCCAGCTTCCAGGCTGGACAAAGCAGGGGG
CTACTTCTCCCTTCCCTCGGTTCCAGTCTTCCCTTTAAAAGCCTGTGGCATTTTTCCTCCTT
CTCCCTAACTTTAGAAATGTTGTACTTGGCTATTTTGATTAGGGAAGAGGGATGTGGTCTCT
GATCTCTGTTGTCTTCTTGGGTCTTTGGGGTTGAAGGGAGGGGGAAGGCAGGCCAGAAGGGA
ATGGAGACATTCGAGGCGGCCTCAGGAGTGGATGCGATCTGTCTCTCCTGGCTCCACTCTTG
CCGCCTTCCAGCTCTGAGTCTTGGGAATGTTGTTACCCTTGGAAGATAAAGCTGGGTCTTCA
GGAACTCAGTGTCTGGGAGGAAAGCATGGCCCAGCATTCAGCATGTGTTCCTTTCTGCAGTG
GTTCTTATCACCACCTCCCTCCCAGCCCCGGCGCCTCAGCCCCAGCCCCAGCTCCAGCCCTG
AGGACAGCTCTGATGGGAGAGCTGGGCCCCTGAGCCCACTGGGTCTTCAGGGTGCACTGGA
AGCTGGTGTTCGCTGTCCCCTGTGCACTTCTCGCACTGGGGCATGGAGTGCCCATGCATACT
CTGCTGCCGGTCCCCTCACCTGCACTTGAGGGGTCTGGGCAGTCCCTCCTCTCCCAGTGTC
CACAGTCACTGAGCCAGACGGTCGGTTGGAACATGAGACTCGAGGCTGAGCGTGGATCTGAA
CACCACAGCCCCTGTACTTGGGTTGCCTCTTGTCCCTGAACTTCGTTGTACCAGTGCATGGA
GAGAAATTTTGTCCTCTTGTCTTAGAGTTGTGTGTAAATCAAGGAAGCCATCATTAAATTG
TTTTATTTCTCTCA
```

FIGURE 40

```
</usr/seqdb2/sst/DNA/Dnaseqs.min/ss.DNA60278
<subunit 1 of 1, 183 aa, 1 stop
<MW: 20574, pI: 6.60, NX(S/T): 3
MKLLSLVAVVGCLLVPPAEANKSSEDIRCKCICPPYRNISGHIYNQNVSQKDCNCLHVVEPM
PVPGHDVEAYCLLCECRYEERSTTTIKVIIVIYLSVVGALLLYMAFLMLVDPLIRKPDAYTE
QLHNEEENEDARSMAAAAASLGGPRANTVLERVEGAQQRWKLQVQEQRKTVFDRHKMLS
```

Important features:

Signal peptide:

amino acids 1-20

Transmembrane domain:

amino acids 90-112

N-glycosylation sites.

amino acids 21-24, 38-41 and 47-50

FIGURE 41

```
AGCGGGTCTCGCTTGGGTTCCGCTAATTTCTGTCCTGAGGCGTGAGACTGAGTTCATAGGGTCCTGGGTCCCCGA
ACCAGGAAGGGTTGAGGGAACACAATCTGCAAGCCCCCGCGACCCAAGTGAGGGGCCCCGTGTTGGGGTCCTCCC
TCCCTTTGCATTCCCACCCCTCCGGGCTTTGCGTCTTCCTGGGGACCCCCTCGCCGGGAGATGGCCGCGTTGATG
CGGAGCAAGGATTCGTCCTGCTGCCTGCTCCTACTGGCCGCGGTGCTGATGGTGGAGAGCTCACAGATCGGCAGT
TCGCGGGCCAAACTCAACTCCATCAAGTCCTCTCTGGGCGGGGAGACGCCTGGTCAGGCCGCCAATCGATCTGCG
GGCATGTACCAAGGACTGGCATTCGGCGGCAGTAAGAAGGGCAAAAACCTGGGGCAGGCCTACCCTTGTAGCAGT
GATAAGGAGTGTGAAGTTGGGAGGTATTGCCACAGTCCCCACCAAGGATCATCGGCCTGCATGGTGTGTCGGAGA
AAAAAGAAGCGCTGCCACCGAGATGGCATGTGCTGCCCCAGTACCCGCTGCAATAATGGCATCTGTATCCCAGTT
ACTGAAAGCATCTTAACCCCTCACATCCCGGCTCTGGATGGTACTCGGCACAGAGATCGAAACCACGGTCATTAC
TCAAACCATGACTTGGGATGGCAGAATCTAGGAAGACCACACACTAAGATGTCACATATAAAAGGGCATGAAGGA
GACCCCTGCCTACGATCATCAGACTGCATTGAAGGGTTTTGCTGTGCTCGTCATTTCTGGACCAAAATCTGCAAA
CCAGTGCTCCATCAGGGGGAAGTCTGTACCAAACAACGCAAGAAGGGTTCTCATGGGCTGGAAATTTTCCAGCGT
TGCGACTGTGCGAAGGGCCTGTCTTGCAAAGTATGGAAAGATGCCACCTACTCCTCCAAAGCCAGACTCCATGTG
TGTCAGAAAATTTGATCACCATTGAGGAACATCATCAATTGCAGACTGTGAAGTTGTGTATTTAATGCATTATAG
CATGGTGGAAAATAAGGTTCAGATGCAGAAGAATGGCTAAAATAAGAAACGTGATAAGAATATAGATGATCACAA
AAAGGGAGAAAGAAAACATGAACTGAATAGATTAGAATGGGTGACAAATGCAGTGCAGCCAGTGTTTCCATTATG
CAACTTGTCTATGTAAATAATGTACACATTTGTGGAAAATGCTATTATTAAGAGAACAAGCACACAGTGGAAATT
ACTGATGAGTAGCATGTGACTTTCCAAGAGTTTAGGTTGTGCTGGAGGAGAGGTTTCCTTCAGATTGCTGATTGC
TTATACAAATAACCTACATGCCAGATTTCTATTCAACGTTAGAGTTTAACAAAATACTCCTAGAATAACTTGTTA
TACAATAGGTTCTAAAAATAAAATTGCTAAACAAGAAATGAAAACATGGAGCATTGTTAATTTACAACAGAAAAT
TACCTTTTGATTTGTAACACTACTTCTGCTGTTCAATCAAGAGTCTTGGTAGATAAGAAAAAAATCAGTCAATAT
TTCCAAATAATTGCAAATAATGGCCAGTTGTTTAGGAAGGCCTTTAGGAAGACAAATAAATAACAAACAAACAG
CCACAAATACTTTTTTTTCAAAATTTTAGTTTTACCTGTAATTAATAAGAACTGATACAAGACAAAAACAGTTCC
TTCAGATTCTACGGAATGACAGTATATCTCTCTTTATCCTATGTGATTCCTGCTCTGAATGCATTATATTTTCCA
AACTATACCCATAAATTGTGACTAGTAAAATACTTACACAGAGCAGAATTTTCACAGATGGCAAAAAAATTTAAA
GATGTCCAATATATGTGGGAAAAGAGCTAACAGAGAGATCATTATTTCTTAAAGATTGGCCATAACCTATATTTT
GATAGAATTAGATTGGTAAATACATGTATTCATACATACTCTGTGGTAATAGAGACTTAAGCTGGATCTGTACTG
CACTGGAGTAAGCAAGAAATTGGGAAAACTTTTTCGTTTGTTCAGGTTTTGGCAACACATAGATCATATGTCTG
AGGCACAAGTTGGCTGTTCATCTTTGAAACCAGGGGATGCACAGTCTAAATGAATATCTGCATGGATTTGCTAT
CATAATATTTACTATGCAGATGAATTCAGTGTGAGGTCCTGTGTCCGTACTATCCTCAAATTATTTATTTTATAG
TGCTGAGATCCTCAAATAATCTCAATTTCAGGAGGTTTCACAAAATGTACTCCTGAAGTAGACAGAGTAGTGAGG
TTTCATTGCCCTCTATAAGCTTCTGACTAGCCAATGGCATCATCCAATTTTCTTCCCAAACCTCTGCAGCATCTG
CTTTATTGCCAAAGGGCTAGTTTCGGTTTTCTGCAGCCATTGCGGTTAAAAAATATAAGTAGGATAACTTGTAAA
ACCTGCATATTGCTAATCTATAGACACCACAGTTTCTAAATTCTTTGAAACCACTTTACTACTTTTTTTAAACTT
AACTCAGTTCTAAATACTTTGTCTGGAGCACAAAACAATAAAAGGTTATCTTATAGTCGTGACTTTAAACTTTTG
TAGACCACAATTCACTTTTTAGTTTTCTTTTACTTAAATCCCATCTGCAGTCTCAAATTTAAGTTCTCCCAGTAG
AGATTGAGTTTGAGCCTGTATATCTATTAAAAATTTCAACTTCCCACATATATTTACTAAGATGATTAAGACTTA
CATTTTCTGCACAGGTCTGCAAAAACAAAAATTATAAACTAGTCCATCCAAGAACCAAAGTTTGTATAAACAGGT
TGCTATAAGCTTGTGAAATGAAAATGGAACATTTCAATCAAACATTTCCTATATAACAATTATTATATTTACAAT
TTGGTTTCTGCAATATTTTTCTTATGTCCACCCTTTTAAAAATTATTATTTGAAGTAATTTATTTACAGGAAATG
TTAATGAGATGTATTTTCTTATAGAGATATTTCTTACAGAAAGCTTTGTAGCAGAATATATTTGCAGCTATTGAC
TTTGTAATTTAGGAAAAATGTATAATAAGATAAAATCTATTAAATTTTTCTCCTCTAAAAACTGAAAAAAAAAAA
AAAAAAAAAAAAAAAAAAAA
```

FIGURE 42

MAALMRSKDSSCCLLLLAAVLMVESSQIGSSRAKLNSIKSSLGGETPGQAANRSAGMYQGLA
FGGSKKGKNLGQAYPCSSDKECEVGRYCHSPHQGSSACMVCRRKKKRCHRDGMCCPSTRCNN
GICIPVTESILTPHIPALDGTRHRDRNHGHYSNHDLGWQNLGRPHTKMSHIKGHEGDPCLRS
SDCIEGFCCARHFWTKICKPVLHQGEVCTKQRKKGSHGLEIFQRCDCAKGLSCKVWKDATYS
SKARLHVCQKI

Signal peptide:
amino acids 1-25

FIGURE 43

TCTCAATCTGCTGACCTCGTGATCCGCCTGACCTTGTAATCCACCTACCTTGGCCTCCCAAA
GTGTTGGGATTACAGGCGTGAGCCACCGCGCCCGGCCAACATCACGTTTTTAAAAATTGATT
TCTTCAAATTCATGGCAAATATTTCCCTTCCCTTTAACTTCTTATGTCAGAATGAGGAAGGA
TAGCTGCATTTATTTAGTCAGTTTTCATTGCATAGTAATATTTTCATGTAGTATTTTCTAAG
TTATATTTAGTAATTCATATGTTTTAGATTATAGGTTTTAACATACTTGTGAAAATACTTG
ATGTGTTTTAAAGCCTTGGGCAGAAATTCTGTATTGTTGAGGATTTGTTCTTTTATCCCCCT
TTTAAAGTCATCCGTCCTTGGCTCAGGATTTGGAGAGCTTGCACCACCAAAAATGGCAAACA
TCACCAGCTCCCAGATTTTGGACCAGTTGAAAGCTCCGAGTTTGGGCCAGTTTACCACCACC
CCAAGTACACAGCAGAATAGTACAAGTCACCCTACAACTACTACTTCTTGGGACCTCAAGCC
CCCAACATCCCAGTCCTCAGTCCTCAGTCATCTTGACTTCAAATCTCAACCTGAGCCATCCC
CAGTTCTTAGCCAGTTGAGCCAGCGACAACAGCACCAGAGCCAGGCAGTCACTGTTCCTCCT
CCTGGTTTGGAGTCCTTTCCTTCCCAGGCAAAACTTCGAGAATCAACACCTGGAGACAGTCC
CTCCACTGTGAACAAGCTTTTGCAGCTTCCCAGCACGACCATTGAAAATATCTCTGTGTCTG
TCCACCAGCCACAGCCCAAACACATCAAACTTGCTAAGCGGCGGATACCCCAGCTTCTAAG
ATCCCAGCTTCTGCAGTGGAAATGCCTGGTTCAGCAGATGTCACAGGATTAAATGTGCAGTT
TGGGGCTCTGGAATTTGGGTCAGAACCTTCTCTCTCTGAATTTGGATCAGCTCCAAGCAGTG
AAAATAGTAATCAGATTCCCATCAGCTTGTATTCGAAGTCTTTAAGTGAGCCTTTGAATACA
TCTTTATCAATGACCAGTGCAGTACAGAACTCCACATATACAACTTCCGTCATTACCTCCTG
CAGTCTGACAAGCTCATCACTGAATTCTGCTAGTCCAGTAGCAATGTCTTCCTCTTATGACC
AGAGTTCTGTGCATAACAGGATCCCATACCAAAGCCCTGTGAGTTCATCAGAGTCAGCTCCA
GGAACCATCATGAATGGACATGGTGGTGGTCGAAGTCAGCAGACACTAGACAGTAAGTATAG
CAGCAAGCTACTCTTGTCATGGCTGGTGCCAACCAAACAGAGGAAGAGGATAGCTCACGTGA
TGTGGAAAACACCAGTTGGTCAATGGCTCATTCGTTAAAAAGCAGCCCTTTTGCTTTTTGT
TTTTGGACCAGGTGTTGGCTGTGGTGTTATTAGAAATGTCTTAACCACAGCAAGAAGGAGGT
GGTGGTCTCATATTCTTCTGCCCTAATCAGACTGCACCACAAGTGCAGCATACAGTATGCAT
TTTAAAGATGCTTGGGCCAGGCGGGGTGGCTGATGCCCATAATCCCAGTGCTTTGGGGGGCC
AAGGCAGGCAGATTGCCCAAGCTCAGGAGTTTGAGACCACCCTGGGCAACATGGTGAAACTC
TGTCTCTACTAAAATACGAAAACTAGCCGGGTGTGGTGGCGGCGCGTGCCTGTAATCCCAG
CTACTTGGGAGGCTGAGGCACAAGAATCGCTTGAGCCAGCTTGGGCTACAAAGTGAGACTCC
GTCTGAAAAGA

FIGURE 44

MCFKALGRNSVLLRICSFIPLLKSSVLGSFGELAPPKMANITSSQILDQLKAPSLGQFTTT
PSTQQNSTSHPTTTTSWDLKPPTSQSSVLSHLDFKSQPEPSPVLSQLSQRQQHQSQAVTVPP
PGLESFPSQAKLRESTPGDSPSTVNKLLQLPSTTIENISVSVHQPQPKHIKLAKRRIPPASK
IPASAVEMPGSADVTGLNVQFGALEFGSEPSLSEFGSAPSSENSNQIPISLYSKSLSEPLNT
SLSMTSAVQNSTYTTSVITSCSLTSSSLNSASPVAMSSSYDQSSVHNRIPYQSPVSSSESAP
GTIMNGHGGGRSQQTLDSKYSSKLLLSWLVPTKQRKRIAHVMWKTPVGQWLIR

Signal peptide:
amino acids 1-24

FIGURE 45

GCCGAGTGGGACAAAGCCTGGGGCTGGGCGGGGGCCATGGCGCTGCCATCCCGAATCCTGCT
TTGGAAACTTGTGCTTCTGCAGAGCTCTGCTGTTCTCCTGCACTCAGCGGTGGAGGAGACGG
ACGCGGGGCTGTACACCTGCAACCTGCACCATCACTACTGCCACCTCTACGAGAGCCTGGCC
GTCCGCCTGGAGGTCACCGACGGCCCCCGGCCACCCCGCCTACTGGGACGGCGAGAAGGA
GGTGCTGGCGGTGGCGCGCGGCGCACCCGCGCTTCTGACCTGCGTGAACCGCGGGCACGTGT
GGACCGACCGGCACGTGGAGGAGGCTCAACAGGTGGTGCACTGGGACCGGCAGCCGCCCGGG
GTCCCGCACGACCGCGCGGACCGCCTGCTGGACCTCTACGCGTCGGGCGAGCGCCGCGCCTA
CGGGCCCCTTTTTCTGCGCGACCGCGTGGCTGTGGGCGCGGATGCCTTTGAGCGCGGTGACT
TCTCACTGCGTATCGAGCCGCTGGAGGTCGCCGACGAGGGCACCTACTCCTGCCACCTGCAC
CACCATTACTGTGGCCTGCACGAACGCCGCGTCTTCCACCTGACGGTCGCCGAACCCCACGC
GGAGCCGCCCCCCGGGGCTCTCCGGGCAACGGCTCCAGCCACAGCGGCGCCCCAGGCCCAG
ACCCCACACTGGCGCGCGGCCACAACGTCATCAATGTCATCGTCCCCGAGAGCCGAGCCCAC
TTCTTCCAGCAGCTGGGCTACGTGCTGGCCACGCTGCTGCTCTTCATCCTGCTACTGGTCAC
TGTCCTCCTGGCCGCCCGCAGGCGCCGCGGAGGCTACGAATACTCGGACCAGAAGTCGGGAA
AGTCAAAGGGGAAGGATGTTAACTTGGCGGAGTTCGCTGTGGCTGCAGGGGACCAGATGCTT
TACAGGAGTGAGGACATCCAGCTAGATTACAAAAACAACATCCTGAAGGAGAGGGCGGAGCT
GGCCCACAGCCCCCTGCCTGCCAAGTACATCGACCTAGACAAAGGGTTCCGGAAGGAGAACT
GCAAATAGGGAGGCCCTGGGCTCCTGGCTGGGCCAGCAGCTGCACCTCTCCTGTCTGTGCTC
CTCGGGGCATCTCCTGATGCTCCGGGGCTCACCCCCCTTCCAGCGGCTGGTCCCGCTTTCCT
GGAATTTGGCCTGGGCGTATGCAGAGGCCGCCTCCACACCCCTCCCCAGGGGCTTGGTGGC
AGCATAGCCCCCACCCCTGCGGCCTTTGCTCACGGGTGGCCCTGCCCACCCCTGGCACAACC
AAAATCCCACTGATGCCCATCATGCCCTCAGACCCTTCTGGGCTCTGCCCGCTGGGGCCTG
AAGACATTCCTGGAGGACACTCCCATCAGAACCTGGCAGCCCCAAAACTGGGGTCAGCCTCA
GGGCAGGAGTCCCACTCCTCCAGGGCTCTGCTCGTCCGGGGCTGGGAGATGTTCCTGGAGGA
GGACACTCCCATCAGAACTTGGCAGCCTTGAAGTTGGGGTCAGCCTCGGCAGGAGTCCCACT
CCTCCTGGGTGCTGCCTGCCACCAAGAGCTCCCCCACCTGTACCACCATGTGGGACTCCAG
GCACCATCTGTTCTCCCCAGGGACCTGCTGACTTGAATGCCAGCCCTTGCTCCTCTGTGTTG
CTTTGGGCCACCTGGGGCTGCACCCCCTGCCCTTTCTCTGCCCCATCCCTACCCTAGCCTTG
CTCTCAGCCACCTTGATAGTCACTGGGCTCCCTGTGACTTCTGACCCTGACACCCCTCCCTT
GGACTCTGCCTGGGCTGGAGTCTAGGGCTGGGCTACATTTGGCTTCTGTACTGGCTGAGGA
CAGGGGAGGGAGTGAAGTTGGTTTGGGGTGGCCTGTGTTGCCACTCTCAGCACCCCACATTT
GCATCTGCTGGTGGACCTGCCACCATCACAATAAAGTCCCCATCTGATTTTTAAAAAAAAAA
AAAAA

FIGURE 46

```
</usr/seqdb2/sst/DNA/Dnaseqs.min/ss.DNA60618
<subunit 1 of 1, 341 aa, 1 stop
<MW: 38070, pI: 6.88, NX(S/T): 1
MALPSRILLWKLVLLQSSAVLLHSAVEETDAGLYTCNLHHHYCHLYESLAVRLEVTDGPPAT
PAYWDGEKEVLAVARGAPALLTCVNRGHVWTDRHVEEAQQVVHWDRQPPGVPHDRADRLLDL
YASGERRAYGPLFLRDRVAVGADAFERGDFSLRIEPLEVADEGTYSCHLHHHYCGLHERRVF
HLTVAEPHAEPPPRGSPGNGSSHSGAPGPDPTLARGHNVINVIVPESRAHFFQQLGYVLATL
LLFILLLVTVLLAARRRRGGYEYSDQKSGKSKGKDVNLAEFAVAAGDQMLYRSEDIQLDYKN
NILKERAELAHSPLPAKYIDLDKGFRKENCK
```

Important features:

Signal peptide:

amino acids 1-19

Transmembrane domain:

amino acids 237-262

N-glycosylation site.

amino acids 205-208

Cell attachment sequence.

amino acids 151-154

Coproporphyrinogen III oxidase proteins.

amino acids 115-140

FIGURE 47

```
CGCCGGAGGCAGCGGCGGCGTGGCGCAGCGGCGACATGGCCGTTGTCTCAGAGGACGACTTT
CAGCACAGTTCAAACTCCACCTACGGAACCACAAGCAGCAGTCTCCGAGCTGACCAGGAGGC
ACTGCTTGAGAAGCTGCTGGACCGCCCGCCCCCTGGCCTGCAGAGGCCCGAGGACCGCTTCT
GTGGCACATACATCATCTTCTTCAGCCTGGGCATTGGCAGTCTACTGCCATGGAACTTCTTT
ATCACTGCCAAGGAGTACTGGATGTTCAAACTCCGCAACTCCTCCAGCCCAGCCACCGGGGA
GGACCCTGAGGGCTCAGACATCCTGAACTACTTTGAGAGCTACCTTGCCGTTGCCTCCACCG
TGCCCTCCATGCTGTGCCTGGTGGCCAACTTCCTGCTTGTCAACAGGGTTGCAGTCCACATC
CGTGTCCTGGCCTCACTGACGGTCATCCTGGCCATCTTCATGGTGATAACTGCACTGGTGAA
GGTGGACACTTCCTCCTGGACCCGTGGTTTTTTGCGGTCACCATTGTCTGCATGGTGATCC
TCAGCGGTGCCTCCACTGTCTTCAGCAGCAGCATCTACGGCATGACCGGCTCCTTTCCTATG
AGGAACTCCCAAGCACTGATATCAGGAGGAGCCATGGGCGGGACGGTCAGCGCCGTGGCCTC
ATTGGTGGACTTGGCTGCATCCAGTGATGTGAGGAACAGCGCCCTGGCCTTCTTCCTGACGG
CCACCATCTTCCTCGTGCTCTGCATGGGACTCTACCTGCTGCTGTCCAGGCTGGAGTATGCC
AGGTACTACATGAGGCCTGTTCTTGCGGCCCATGTGTTTCTGGTGAAGAGGAGCTTCCCCA
GGACTCCCTCAGTGCCCCTTCGGTGGCCTCCAGATTCATTGATTCCCACACACCCCCTCTCC
GCCCCATCCTGAAGAAGACGGCCAGCCTGGGCTTCTGTGTCACCTACGTCTTCTTCATCACC
AGCCTCATCTACCCCGCCGTCTGCACCAACATCGAGTCCCTCAACAAGGGCTCGGGCTCACT
GTGGACCACCAAGTTTTTCATCCCCCTCACTACCTTCCTCCTGTACAACTTTGCTGACCTAT
GTGGCCGGCAGCTCACCGCCTGGATCCAGGTGCCAGGGCCCAACAGCAAGGCGCTCCCAGGG
TTCGTGCTCCTCCGGACCTGCCTCATCCCCCTCTTCGTGCTCTGTAACTACCAGCCCCGCGT
CCACCTGAAGACTGTGGTCTTCCAGTCCGATGTGTACCCCGCACTCCTCAGCTCCCTGCTGG
GGCTCAGCAACGGCTACCTCAGCACCCTGGCCCTCCTCTACGGGCCTAAGATTGTGCCCAGG
GAGCTGGCTGAGGCCACGGGAGTGGTGATGTCCTTTTATGTGTGCTTGGGCTTAACACTGGG
CTCAGCCTGCTCTACCCTCCTGGTGCACCTCATCTAGAAGGGAGGACACAAGGACATTGGTG
CTTCAGAGCCTTTGAAGATGAGAAGAGAGTGCAGGAGGGCTGGGGGCCATGGAGGAAAGGCC
TAAAGTTTCACTTGGGGACAGAGAGCAGAGCACACTCGGGCCTCATCCCTCCCAAGATGCCA
GTGAGCCACGTCCATGCCCATTCCGTGCAAGGCAGATATTCCAGTCATATTAACAGAACACT
CCTGAGACAGTTGAAGAAGAAATAGCACAAATCAGGGGTACTCCCTTCACAGCTGATGGTTA
ACATTCCACCTTCTTTCTAGCCCTTCAAAGATGCTGCCAGTGTTCGCCCTAGAGTTATTACA
AAGCCAGTGCCAAAACCCAGCCATGGGCTCTTTGCAACCTCCCAGCTGCGCTCATTCCAGCT
GACAGCGAGATGCAAGCAAATGCTCAGCTCTCCTTACCCTGAAGGGGTCTCCCTGGAATGGA
AGTCCCCTGGCATGGTCAGTCCTCAGGCCCAAGACTCAAGTGTGCACAGACCCCTGTGTTCT
GCGGGTGAACAACTGCCCACTAACCAGACTGGAAAACCCAGAAAGATGGGCCTTCCATGAAT
GCTTCATTCCAGAGGGACCAGAGGGCCTCCCTGTGCAAGGGATCAAGCATGTCTGGCCTGGG
TTTTCAAAAAAGAGGGATCCTCATGACCTGGTGGTCTATGGCCTGGGTCAAGATGAGGGTC
TTTCAGTGTTCCTGTTTACAACATGTCAAAGCCATTGGTTCAAGGGCGTAATAAATACTTGC
GTATTCAAAAA
```

FIGURE 48

MAVVSEDDFQHSSNSTYGTTSSSLRADQEALLEKLLDRPPPGLQRPEDRFCGTYIIFFSLGI
GSLLPWNFFITAKEYWMFKLRNSSSPATGEDPEGSDILNYFESYLAVASTVPSMLCLVANFL
LVNRVAVHIRVLASLTVILAIFMVITALVKVDTSSWTRGFFAVTIVCMVILSGASTVFSSSI
YGMTGSFPMRNSQALISGGAMGGTVSAVASLVDLAASSDVRNSALAFFLTATIFLVLCMGLY
LLLSRLEYARYYMRPVLAAHVFSGEEELPQDSLSAPSVASRFIDSHTPPLRPILKKTASLGF
CVTYVFFITSLIYPAVCTNIESLNKGSGSLWTTKFFIPLTTFLLYNFADLCGRQLTAWIQVP
GPNSKALPGFVLLRTCLIPLFVLCNYQPRVHLKTVVFQSDVYPALLSSLLGLSNGYLSTLAL
LYGPKIVPRELAEATGVVMSFYVCLGLTLGSACSTLLVHLI

Transmembrane domain:

amino acids 50-74 (type II), 105-127, 135-153, 163-183, 228-252, 305-330, 448-472

FIGURE 49

```
GACAGTGGAGGGCAGTGGAGAGGACCGCGCTGTCCTGCTGTCACCAAGAGCTGGAGACACCA
TCTCCCACCGAGAGTCATGGCCCCATTGGCCCTGCACCTCCTCGTCCTCGTCCCCATCCTCC
TCAGCCTGGTGGCCTCCCAGGACTGGAAGGCTGAACGCAGCCAAGACCCCTTCGAGAAATGC
ATGCAGGATCCTGACTATGAGCAGCTGCTCAAGGTGGTGACCTGGGGGCTCAATCGGACCCT
GAAGCCCCAGAGGGTGATTGTGGTTGGCGCTGGTGTGGCCGGGCTGGTGGCCGCCAAGGTGC
TCAGCGATGCTGGACACAAGGTCACCATCCTGGAGGCAGATAACAGGATCGGGGGCCGCATC
TTCACCTACCGGGACCAGAACACGGGCTGGATTGGGGAGCTGGGAGCCATGCGCATGCCCAG
CTCTCACAGGATCCTCCACAAGCTCTGCCAGGGCCTGGGGCTCAACCTGACCAAGTTCACCC
AGTACGACAAGAACACGTGGACGGAGGTGCACGAAGTGAAGCTGCGCAACTATGTGGTGGAG
AAGGTGCCCGAGAAGCTGGGCTACGCCTTGCGTCCCCAGGAAAAGGGCCACTCGCCCGAAGA
CATCTACCAGATGGCTCTCAACCAGGCCCTCAAAGACCTCAAGGCACTGGGCTGCAGAAAGG
CGATGAAGAAGTTTGAAAGGCACACGCTCTTGGAATATCTTCTCGGGGAGGGGAACCTGAGC
CGGCCGGCCGTGCAGCTTCTGGGAGACGTGATGTCCGAGGATGGCTTCTTCTATCTCAGCTT
CGCCGAGGCCCTCCGGGCCCACAGCTGCCTCAGCGACAGACTCCAGTACAGCCGCATCGTGG
GTGGCTGGGACCTGCTGCCGCGCGCTGCTGAGCTCGCTGTCCGGGCTTGTGCTGTTGAAC
GCGCCCGTGGTGGCGATGACCCAGGGACCGCACGATGTGCACGTGCAGATCGAGACCTCTCC
CCCGGCGCGGAATCTGAAGGTGCTGAAGGCCGACGTGGTGCTGCTGACGGCGAGCGGACCGG
CGGTGAAGCGCATCACCTTCTCGCCGCCGCTGCCCCGCCACATGCAGGAGGCGCTGCGGAGG
CTGCACTACGTGCCGGCCACCAAGGTGTTCCTAAGCTTCCGCAGGCCCTTCTGGCGCGAGGA
GCACATTGAAGGCGGCCACTCAAACACCGATCGCCCGTCGCGCATGATTTTCTACCCGCCGC
CGCGCGAGGGCGCGCTGCTGCTGGCCTCGTACACGTGGTCGGACGCGGCGGCAGCGTTCGCC
GGCTTGAGCCGGGAAGAGGCGTTGCGCTTGGCGCTCGACGACGTGGCGGCATTGCACGGGCC
TGTCGTGCGCCAGCTCTGGGACGGCACCGGCGTCGTCAAGCGTTGGGCGGAGGACCAGCACA
GCCAGGGTGGCTTTGTGGTACAGCCGCCGGCGCTCTGGCAAACCGAAAAGGATGACTGGACG
GTCCCTTATGGCCGCATCTACTTTGCCGGCGAGCACACCGCCTACCCGCACGGCTGGGTGGA
GACGGCGGTCAAGTCGGCGCTGCGCGCCGCCATCAAGATCAACAGCCGGAAGGGGCCTGCAT
CGGACACGGCCAGCCCCGAGGGGCACGCATCTGACATGGAGGGGCAGGGCATGTGCATGGG
GTGGCCAGCAGCCCCTCGCATGACCTGGCAAAGGAAGAAGGCAGCCACCCTCCAGTCCAAGG
CCAGTTATCTCTCCAAAACACGACCCACACGAGGACCTCGCATTAAAGTATTTTCGGAAAAA
AAAAAAAAAAAAAAAAAAAAAAAAAAAAAAAAAAAAAAAAAAAA
```

FIGURE 50

MAPLALHLLVLVPILLSLVASQDWKAERSQDPFEKCMQDPDYEQLLKVVTWGLNRTLKPQRV
IVVGAGVAGLVAAKVLSDAGHKVTILEADNRIGGRIFTYRDQNTGWIGELGAMRMPSSHRIL
HKLCQGLGLNLTKFTQYDKNTWTEVHEVKLRNYVVEKVPEKLGYALRPQEKGHSPEDIYQMA
LNQALKDLKALGCRKAMKKFERHTLLEYLLGEGNLSRPAVQLLGDVMSEDGFFYLSFAEALR
AHSCLSDRLQYSRIVGGWDLLPRALLSSLSGLVLLNAPVVAMTQGPHDVHVQIETSPPARNL
KVLKADVVLLTASGPAVKRITFSPPLPRHMQEALRRLHYVPATKVFLSFRRPFWREEHIEGG
HSNTDRPSRMIFYPPPREGALLLASYTWSDAAAAFAGLSREEALRLALDDVAALHGPVVRQL
WDGTGVVKRWAEDQHSQGGFVVQPPALWQTEKDDWTVPYGRIYFAGEHTAYPHGWVETAVKS
ALRAAIKINSRKGPASDTASPEGHASDMEGQGHVHGVASSPSHDLAKEEGSHPPVQGQLSLQ
NTTHTRTSH

Signal peptide:
amino acids 1-21

FIGURE 51

```
CTGACATGGCCTGACTCGGGACAGCTCAGAGCAGGGCAGAACTGGGGACACTCTGGGCCGGCCTTCTGCCTGCAT
GGACGCTCTGAAGCCACCCTGTCTCTGGAGGAACCACGAGCGAGGGAAGAAGGACAGGGACTCGTGTGGCAGGAA
GAACTCAGAGCCGGGAAGCCCCCATTCACTAGAAGCACTGAGAGATGCGGCCCCCTCGCAGGGTCTGAATTTCCT
GCTGCTGTTCACAAAGATGCTTTTTATCTTTAACTTTTTGTTTTCCCCACTTCCGACCCCGGCGTTGATCTGCAT
CCTGACATTTGGAGCTGCCATCTTCTTGTGGCTGATCACCAGACCTCAACCCGTCTTACCTCTTCTTGACCTGAA
CAATCAGTCTGTGGGAATTGAGGGAGGAGCACGGAAGGGGGTTTCCCAGAAGAACAATGACCTAACAAGTTGCTG
CTTCTCAGATGCCAAGACTATGTATGAGGTTTTCCAAAGAGGACTCGCTGTGTCTGACAATGGGCCCTGCTTGGG
ATATAGAAAACCAAACCAGCCCTACAGATGGCTATCTTACAAACAGGTGTCTGATAGAGCAGAGTACCTGGGTTC
CTGTCTCTTGCATAAAGGTTATAAATCATCACCAGACCAGTTTGTCGGCATCTTTGCTCAGAATAGGCCAGAGTG
GATCATCTCCGAATTGGCTTGTTACACGTACTCTATGGTAGCTGTACCTCTGTATGACACCTTGGGACCAGAAGC
CATCGTACATATTGTCAACAAGGCTGATATCGCCATGGTGATCTGTGACACACCCCAAAAGGCATTGGTGCTGAT
AGGGAATGTAGAGAAAGGCTTCACCCCGAGCCTGAAGGTGATCATCCTTATGGACCCCTTTGATGATGACCTGAA
GCAAAGAGGGGAGAAGAGTGGAATTGAGATCTTATCCCTATATGATGCTGAGAACCTAGGCAAAGAGCACTTCAG
AAAACCTGTGCCTCCTAGCCCAGAAGACCTGAGCGTCATCTGCTTCACCAGTGGGACCACAGGTGACCCCAAAGG
AGCCATGATAACCCATCAAAATATTGTTTCAAATGCTGCTGCCTTTCTCAAATGTGTGGAGCATGCTTATGAGCC
CACTCCTGATGATGTGGCCATATCCTACCTCCCTCTGGCTCATATGTTTGAGAGGATTGTACAGGCTGTTGTGTA
CAGCTGTGGAGCCAGAGTTGGATTCTTCCAAGGGGATATTCGGTTGCTGGCTGACGACATGAAGACTTTGAAGCC
CACATTGTTTCCCGCGGTGCCTCGACTCCTTAACAGGATCTACGATAAGGTACAAAATGAGGCCAAGACACCCTT
GAAGAAGTTCTTGTTGAAGCTGGCTGTTTCCAGTAAATTCAAAGAGCTTCAAAAGGGTATCATCAGGCATGATAG
TTTCTGGGACAAGCTCATCTTTGCAAAGATCCAGGACAGCCTGGGCGGAAGGGTTCGTGTAATTGTCACTGGAGC
TGCCCCCATGTCCACTTCAGTCATGACATTCTTCCGGGCAGCAATGGGATGTCAGGTGTATGAAGCTTATGGTCA
AACAGAATGCACAGGTGGCTGTACATTTACATTACCTGGGGACTGGACATCAGGTCACGTTGGGGTGCCCCTGGC
TTGCAATTACGTGAAGCTGGAAGATGTGGCTGACATGAACTACTTTACAGTGAATAATGAAGGAGAGGTCTGCAT
CAAGGGTACAAACGTGTTCAAAGGATACCTGAAGGACCCTGAGAAGACACAGGAAGCCCTGGACAGTGATGGCTG
GCTTCACACAGGAGACATTGGTCGCTGGCTCCCGAATGGAACTCTGAAGATCATCGACCGTAAAAAGAACATTTT
CAAGCTGGCCCAAGGAGAATACATTGCACCAGAGAAGATAGAAAATATCTACAACAGGAGTCAACCAGTGTTACA
AATTTTTGTACACGGGGAGAGCTTACGGTCATCCTTAGTAGGAGTGGTGGTTCCTGACACAGATGTACTTCCCTC
ATTTGCAGCCAAGCTTGGGGTGAGGGCTCCTTTGAGGAACTGTGCCAAAACCAAGTTGTAAGGGAAGCCATTTT
AGAAGACTTGCAGAAAATTGGGAAAGAAAGTGGCCTTAAAACTTTTGAACAGGTCAAAGCCATTTTTCTTCATCC
AGAGCCATTTTCCATTGAAAATGGGCTCTTGACACCAACATTGAAAGCAAAGCGAGGAGAGCTTTCCAAATACTT
TCGGACCCAAATTGACAGCCTGTATGAGCACATCCAGGATTAGGATAAGGTACTTAAGTACCTGCCGGCCCACTG
TGCACTGCTTGTGAGAAAATGGATTAAAAACTATTCTTACATTTGTTTTGCCTTTCCTCCTATTTTTTTTTAACC
TGTTAAACTCTAAAGCCATAGCTTTTGTTTTATATTGAGACATATAATGTGTAAACTTAGTTCCCAAATAAATCA
ATCCTGTCTTTCCCATCTTCGATGTTGCTAATATTAAGGCTTCAGGGCTACTTTTATCAACATGCCTGTCTTCAA
GATCCCAGTTTATGTTCTGTGTCCTTCCTCATGATTTCCAACCTTAATACTATTAGTAACCACAAGTTCAAGGGT
CAAAGGGACCCTCTGTGCCTTCTTCTTTGTTTTGTGATAAACATAACTTGCCAACAGTCTCTATGCTTATTTACA
TCTTCTACTGTTCAAACTAAGAGATTTTTAAATTCTGAAAAACTGCTTACAATTCATGTTTTCTAGCCACTCCAC
AAACCACTAAAATTTTAGTTTTAGCCTATCACTCATGTCAATCATATCTATGAGACAAATGTCTCCGATGCTCTT
CTGCGTAAATTAAATTGTGTACTGAAGGGAAAAGTTTGATCATACCAAACATTTCCTAAACTCTCTAGTTAGATA
TCTGACTTGGGAGTATTAAAAATTGGGTCTATGACATACTGTCCAAAAGGAATGCTGTTCTTAAAGCATTATTTA
CAGTAGGAACTGGGGAGTAAATCTGTTCCCTACAGTTTGCTGCTGAGCTGGAAGCTGTGGGGGAAGGAGTTGACA
GGTGGGCCCAGTGAACTTTTCCAGTAAATGAAGCAAGCACTGAATAAAAACCTCCTGAACTGGGAACAAAGATCT
ACAGGCAAGCAAGATGCCCACACAACAGGCTTATTTTCTGTGAAGGAACCAACTGATCTCCCCCACCCTTGGATT
AGAGTTCCTGCTCTACCTTACCCACAGATAACACATGTTGTTTCTACTTGTAAATGTAAAGTCTTTAAAATAAAC
TATTACAGATAAAAAA
```

FIGURE 52

</usr/seqdb2/sst/DNA/Dnaseqs.min/ss.DNA60775
<subunit 1 of 1, 739 aa, 1 stop
<MW: 82263, pI: 7.55, NX(S/T): 3

MDALKPPCLWRNHERGKKDRDSCGRKNSEPGSPHSLEALRDAAPSQGLNFLLLFTKMLFIFN
FLFSPLPTPALICILTFGAAIFLWLITRPQPVLPLLDLNNQSVGIEGGARKGVSQKNNDLTS
CCFSDAKTMYEVFQRGLAVSDNGPCLGYRKPNQPYRWLSYKQVSDRAEYLGSCLLHKGYKSS
PDQFVGIFAQNRPEWIISELACYTYSMVAVPLYDTLGPEAIVHIVNKADIAMVICDTPQKAL
VLIGNVEKGFTPSLKVIILMDPFDDDLKQRGEKSGIEILSLYDAENLGKEHFRKPVPPSPED
LSVICFTSGTTGDPKGAMITHQNIVSNAAAFLKCVEHAYEPTPDDVAISYLPLAHMFERIVQ
AVVYSCGARVGFFQGDIRLLADDMKTLKPTLFPAVPRLLNRIYDKVQNEAKTPLKKFLLKLA
VSSKFKELQKGIIRHDSFWDKLIFAKIQDSLGGRVRVIVTGAAPMSTSVMTFFRAAMGCQVY
EAYGQTECTGGCTFTLPGDWTSGHVGVPLACNYVKLEDVADMNYFTVNNEGEVCIKGTNVFK
GYLKDPEKTQEALDSDGWLHTGDIGRWLPNGTLKIIDRKKNIFKLAQGEYIAPEKIENIYNR
SQPVLQIFVHGESLRSSLVGVVVPDTDVLPSFAAKLGVKGSFEELCQNQVVREAILEDLQKI
GKESGLKTFEQVKAIFLHPEPFSIENGLLTPTLKAKRGELSKYFRTQIDSLYEHIQD

Important features:

Type II transmembrane domain:

amino acids 61-80

Putative AMP-binding domain signature.

amino acids 314-325

N-glycosylation site.

amino acids 102-105, 588-591 and 619-622

FIGURE 53

```
GGAGGCGGAGGCCGCGGCGAGCCGGGCCGAGCAGTGAGGGCCCTAGCGGGGCCCGAGCGGGG
CCCGGGGCCCCTAAGCCATTCCTGAAGTCATGGGCTGGCCAGGACATTGGTGACCCGCCAAT
CCGGTATGGACGACTGGAAGCCCAGCCCCCTCATCAAGCCCTTTGGGGCTCGGAAGAAGCGG
AGCTGGTACCTTACCTGGAAGTATAAACTGACAAACCAGCGGGCCCTGCGGAGATTCTGTCA
GACAGGGGCCGTGCTTTTCCTGCTGGTGACTGTCATTGTCAATATCAAGTTGATCCTGGACA
CTCGGCGAGCCATCAGTGAAGCCAATGAAGACCCAGAGCCAGAGCAAGACTATGATGAGGCC
CTAGGCCGCCTGGAGCCCCACGGCGCAGAGGCAGTGGTCCCCGGCGGTCCTGGACGTAGA
GGTGTATTCAAGTCGCAGCAAAGTATATGTGGCAGTGGATGGCACCACGGTGCTGGAGGATG
AGGCCCGGGAGCAGGGCCGGGGCATCCATGTCATTGTCCTCAACCAGGCCACGGGCCACGTG
ATGGCAAAACGTGTGTTTGACACGTACTCACCTCATGAGGATGAGGCCATGGTGCTATTCCT
CAACATGGTAGCGCCCGGCCGAGTGCTCATCTGCACTGTCAAGGATGAGGGCTCCTTCCACC
TCAAGGACACAGCCAAGGCTCTGCTGAGGAGCCTGGGCAGCCAGGCTGGCCCTGCCCTGGGC
TGGAGGGACACATGGGCCTTCGTGGGACGAAAAGGAGGTCCTGTCTTCGGGGAGAAACATTC
TAAGTCACCTGCCCTCTCTTCCTGGGGGGACCCAGTCCTGCTGAAGACAGATGTGCCATTGA
GCTCAGCAGAAGAGGCAGAGTGCCACTGGGCAGACACAGAGCTGAACCGTCGCCGCCGGCGC
TTCTGCAGCAAAGTTGAGGGCTATGGAAGTGTATGCAGCTGCAAGGACCCCACACCCATCGA
GTTCAGCCCTGACCCACTCCCAGACAACAAGGTCCTCAATGTGCCTGTGGCTGTCATTGCAG
GGAACCGACCCAATTACCTGTACAGGATGCTGCGCTCTCTGCTTTCAGCCCAGGGGGTGTCT
CCTCAGATGATAACAGTTTTCATTGACGGCTACTATGAGGAACCCATGGATGTGGTGGCACT
GTTTGGTCTGAGGGGCATCCAGCATACTCCCATCAGCATCAAGAATGCCCGCGTGTCTCAGC
ACTACAAGGCCAGCCTCACTGCCACTTTCAACCTGTTTCCGGAGGCCAAGTTTGCTGTGGTT
CTGGAAGAGGACCTGGACATTGCTGTGGATTTTTTCAGTTTCCTGAGCCAATCCATCCACCT
ACTGGAGGAGGATGACAGCCTGTACTGCATCTCTGCCTGGAATGACCAGGGGTATGAACACA
CGGCTGAGGACCCAGCACTACTGTACCGTGTGGAGACCATGCCTGGGCTGGGCTGGGTGCTC
AGGAGGTCCTTGTACAAGGAGGAGCTTGAGCCCAAGTGGCCTACACCGGAAAAGCTCTGGGA
TTGGGACATGTGGATGCGGATGCCTGAACAACGCCGGGGCCGAGAGTGCATCATCCCTGACG
TTTCCCGATCCTACCACTTTGGCATCGTCGGCCTCAACATGAATGGCTACTTTCACGAGGCC
TACTTCAAGAAGCACAAGTTCAACACGGTTCCAGGTGTCCAGCTCAGGAATGTGGACAGTCT
GAAGAAAGAAGCTTATGAAGTGGAAGTTCACAGGCTGCTCAGTGAGGCTGAGGTTCTGGACC
ACAGCAAGAACCCTTGTGAAGACTCTTTCCTGCCAGACACAGAGGGCCACACCTACGTGGCC
TTTATTCGAATGGAGAAAGATGATGACTTCACCACCTGGACCCAGCTTGCCAAGTGCCTCCA
TATCTGGGACCTGGATGTGCGTGGCAACCATCGGGGCCTGTGGAGATTGTTTCGGAAGAAGA
ACCACTTCCTGGTGGTGGGGGTCCCGGCTTCCCCCTACTCAGTGAAGAAGCCACCCTCAGTC
ACCCCAATTTTCCTGGAGCCACCCCAAAGGAGGAGGGAGCCCCAGGAGCCCCAGAACAGAC
ATGAGACCTCCTCCAGGACCCTGCGGGGCTGGGTACTGTGTACCCCCAGGCTGGCTAGCCCT
TCCCTCCATCCTGTAGGATTTTGTAGATGCTGGTAGGGGCTGGGGCTACCTTGTTTTTAACA
TGAGACTTAATTACTAACTCCAAGGGGAGGGTTCCCCTGCTCCAACACCCCGTTCCTGAGTT
AAAAGTCTATTTATTTACTTCCTTGTTGGAGAAGGGCAGGAGAGTACCTGGGAATCATTACG
ATCCCTAGCAGCTCATCCTGCCCTTTGAATACCCTCACTTTCCAGGCCTGGCTCAGAATCTA
ACCTATTTATTGACTGTCCTGAGGGCCTTGAAAACAGGCCGAACCTGGAGGGCCTGGATTTC
TTTTTGGGCTGGAATGCTGCCCTGAGGGTGGGCTGGCTCTTACTCAGGAAACTGCTGTGCC
CAACCCATGGACAGGCCCAGCTGGGGCCCACATGCTGACACAGACTCACTCAGAGACCCTTA
GACACTGGACCAGGCCTCCTCTCAGCCTTCTCTTTGTCCAGATTTCCAAAGCTGGATAAGTT
GGTCATTGATTAAAAAAGGAGAAGCCCTCTGGGAAAAAAAAAAAAAAAAAAAAAAAAAA
```

FIGURE 54

></usr/seqdb2/sst/DNA/Dnaseqs.min/ss.DNA61185
><subunit 1 of 1, 660 aa, 1 stop
><MW: 75220, pI: 6.76, NX(S/T): 0
MDDWKPSPLIKPFGARKKRSWYLTWKYKLTNQRALRRFCQTGAVLFLLVTVIVNIKLILDTR
RAISEANEDPEPEQDYDEALGRLEPPRRRGSGPRRVLDVEVYSSRSKVYVAVDGTTVLEDEA
REQGRGIHVIVLNQATGHVMAKRVFDTYSPHEDEAMVLFLNMVAPGRVLICTVKDEGSFHLK
DTAKALLRSLGSQAGPALGWRDTWAFVGRKGGPVFGEKHSKSPALSSWGDPVLLKTDVPLSS
AEEAECHWADTELNRRRRRFCSKVEGYGSVCSCKDPTPIEFSPDPLPDNKVLNVPVAVIAGN
RPNYLYRMLRSLLSAQGVSPQMITVFIDGYYEEPMDVVALFGLRGIQHTPISIKNARVSQHY
KASLTATFNLFPEAKFAVVLEEDLDIAVDFFSFLSQSIHLLEEDDSLYCISAWNDQGYEHTA
EDPALLYRVETMPGLGWVLRRSLYKEELEPKWPTPEKLWDWDMWMRMPEQRRGRECIIPDVS
RSYHFGIVGLNMNGYFHEAYFKKHKFNTVPGVQLRNVDSLKKEAYEVEVHRLLSEAEVLDHS
KNPCEDSFLPDTEGHTYVAFIRMEKDDDFTTWTQLAKCLHIWDLDVRGNHRGLWRLFRKKNH
FLVVGVPASPYSVKKPPSVTPIFLEPPPKEEGAPGAPEQT

Important features of the protein:

Transmembrane domain:

amino acids 38-55

Homologous region to Mouse GNT1 amino acids 229-660

FIGURE 55

```
CGGACGCGTGGGCTGCTGGTGGGAAGGCCTAAAGAACTGGAAAGCCCACTCTCTTGGAACCACCACAC
CTGTTTAAAGAACCTAAGCACCATTTAAAGCCACTGGAAATTTGTTGTCTAGTGGTTGTGGGTGAATA
AAGGAGGGCAGAATGGATGATTTCATCTCCATTAGCCTGCTGTCTCTGGCTATGTTGGTGGGATGTTA
CGTGGCCGGAATCATTCCCTTGGCTGTTAATTTCTCAGAGGAACGACTGAAGCTGGTGACTGTTTTGG
GTGCTGGCCTTCTCTGTGGAACTGCTCTGGCAGTCATCGTGCCTGAAGGAGTACATGCCCTTTATGAA
GATATTCTTGAGGGAAAACACCACCAAGCAAGTGAAACACATAATGTGATTGCATCAGACAAAGCAGC
AGAAAAATCAGTTGTCCATGAACATGAGCACAGCCACGACCACACACAGCTGCATGCCTATATTGGTG
TTTCCCTCGTTCTGGGCTTCGTTTTCATGTTGCTGGTGGACCAGATTGGTAACTCCCATGTGCATTCT
ACTGACGATCCAGAAGCAGCAAGGTCTAGCAATTCCAAAATCACCACCACGCTGGGTCTGGTTGTCCA
TGCTGCAGCTGATGGTGTTGCTTTGGGAGCAGCAGCATCTACTTCACAGACCAGTGTCCAGTTAATTG
TGTTTGTGGCAATCATGCTACATAAGGCACCAGCTGCTTTTGGACTGGTTTCCTTCTTGATGCATGCT
GGCTTAGAGCGGAATCGAATCAGAAAGCACTTGCTGGTCTTTGCATTGGCAGCACCAGTTATGTCCAT
GGTGACATACTTAGGACTGAGTAAGAGCAGTAAAGAAGCCCTTTCAGAGGTGAACGCCACGGGAGTGG
CCATGCTTTTCTCTGCCGGGACATTTCTTTATGTTGCCACAGTACATGTCCTCCCTGAGGTGGGCGGA
ATAGGGCACAGCCACAAGCCCGATGCCACGGGAGGGAGAGGCCTCAGCCGCCTGGAAGTGGCAGCCCT
GGTTCTGGGTTGCCTCATCCCTCTCATCCTGTCAGTAGGACACCAGCATTAAATGTTCAAGGTCCAGC
CTTGGTCCAGGGCCGTTTGCCATCCAGTGAGAACAGCCGGCACGTGACAGCTACTCACTTCCTCAGTC
TCTTGTCTCACCTTGCGCATCTCTACATGTATTCCTAGAGTCCAGAGGGGAGGTGAGGTTAAAACCTG
AGTAATGGAAAAGCTTTTAGAGTAGAAACACATTTACGTTGCAGTTAGCTATAGACATCCCATTGTGT
TATCTTTTAAAAGGCCCTTGACATTTTGCGTTTTAATATTTCTCTTAACCCTATTCTCAGGGAAGATG
GAATTTAGTTTTAAGGAAAAGAGGAGAACTTCATACTCACAATGAAATAGTGATTATGAAAATACAGT
GTTCTGTAATTAAGCTATGTCTCTTTCTTCTTAGTTTAGAGGCTCTGCTACTTTATCCATTGATTTTT
AACATGGTTCCCACCATGTAAGACTGGTGCTTTAGCATCTATGCCACATGCGTTGATGGAAGGTCATA
GCACCCACTCACTTAGATGCTAAAGGTGATTCTAGTTAATCTGGGATTAGGGTCAGGAAAATGATAGC
AAGACACATTGAAAGCTCTCTTTATACTCAAAAGAGATATCCATTGAAAAGGGATGTCTAGAGGGATT
TAAACAGCTCCTTTGGCACGTGCCTCTCTGAATCCAGCCTGCCATTCCATCAAATGGAGCAGGAGAGG
TGGGAGGAGCTTCTAAAGAGGTGACTGGTATTTTGTAGCATTCCTTGTCAAGTTCTCCTTTGCAGAAT
ACCTGTCTCCACATTCCTAGAGAGGAGCCAAGTTCTAGTAGTTTCAGTTCTAGGCTTTCCTTCAAGAA
CAGTCAGATCACAAAGTGTCTTTGGAAATTAAGGGATATTAAATTTTAAGTGATTTTTGGATGGTTAT
TGATATCTTTGTAGTAGCTTTTTTAAAAGACTACCAAAATGTATGGTTGTCCTTTTTTTTGTTTTT
TTTTTTTTTAATTATTTCTCTTAGCAGATCAGCAATCCCTCTAGGGACCTAAATACTAGGTCAGCTTT
GGCGACACTGTGTCTTCTCACATAACCACCTGTAGCAAGATGGATCATAAATGAGAAGTGTTTGCCTA
TTGATTTAAAGCTTATTGGAATCATGTCTCTTGTCTCTTCGTCGTTGTTCTTTGCTTTTCTTCTAACTTT
TCCCTCTAGCCTCTCCTCGCCACAATTTGCTGCTTACTGCTGGTGTTAATATTTGTGTGGGATGAATT
CTTATCAGGACAACCACTTCTCGAACTGTAATAATGAAGATAATAATATCTTTATTCTTTATCCCCTT
CAAAGAAATTACCTTTGTGTCAAATGCCGCTTTGTTGAGCCCTTAAAATACCACCTCCTCATGTGTAA
ATTGACACAATCACTAATCTGGTAATTTAAACAATTGAGATAGCAAAAGTGTTTAACAGACTAGGATA
ATTTTTTTTTCATATTTGCCAAAATTTTTGTAAACCCTGTCTTGTCAAATAAGTGTATAATATTGTAT
TATTAATTTATTTTTACTTTCTATACCATTTCAAAACACATTACACTAAGGGGGAACCAAGACTAGTT
TCTTCAGGGCAGTGGACGTAGTAGTTTGTAAAAACGTTTTCTATGACGCATAAGCTAGCATGCCTATG
ATTTATTTCCTTCATGAATTTGTCACTGGATCAGCAGCTGTGGAAATAAAGCTTGTGAGCCCTCTGCT
GGCCACAGTGAGGAAAGTAGCACAAATAGGATACAGTTGTATGTAGTCATTGGCAACAATTGCATACA
ATTTACTACCAAGAGAAGGTATAGTATGGAAAGTCCAAATGACTTCCTTGATTGGATGTTAACAGCT
GACTGGTGTGAGACTTGAGGTTTCATCTAGTCCTTCAAAACTATATGGTTGCCTAGATTCTCTCTGGA
AACTGACTTTGTCAAATAAATAGCAGATTGTAGTGTCAAAAAAAA
```

FIGURE 56

MDDFISISLLSLAMLVGCYVAGIIPLAVNFSEERLKLVTVLGAGLLCGTALAVIVPEGVHAL
YEDILEGKHHQASETHNVIASDKAAEKSVVHEHEHSHDHTQLHAYIGVSLVLGFVFMLLVDQ
IGNSHVHSTDDPEAARSSNSKITTTLGLVVHAAADGVALGAAASTSQTSVQLIVFVAIMLHK
APAAFGLVSFLMHAGLERNRIRKHLLVFALAAPVMSMVTYLGLSKSSKEALSEVNATGVAML
FSAGTFLYVATVHVLPEVGGIGHSHKPDATGGRGLSRLEVAALVLGCLIPLILSVGHQH

Signal peptide:

amino acids 1-18

Transmembrane domain:

amino acids 37-56, 106-122, 211-230, 240-260, 288-304

FIGURE 57

GCTCGAGGCCGGCGGCGGCGGGAGAGCGACCCGGGCGGCCTCGTAGCGGGGCCCCGGATCCC
CGAGTGGCGGCCGGAGCCTCGAAAAGAGATTCTCAGCGCTGATTTTGAGATGATGGGCTTGG
GAAACGGGCGTCGCAGCATGAAGTCGCCGCCCCTCGTGCTGGCCGCCCTGGTGGCCTGCATC
ATCGTCTTGGGCTTCAACTACTGGATTGCGAGCTCCCGGAGCGTGGACCTCCAGACACGGAT
CATGGAGCTGGAAGGCAGGGTCCGCAGGGCGGCTGCAGAGAGAGGCGCCGTGGAGCTGAAGA
AGAACGAGTTCCAGGGAGAGCTGGAGAAGCAGCGGGAGCAGCTTGACAAAATCCAGTCCAGC
CACAACTTCCAGCTGGAGAGCGTCAACAAGCTGTACCAGGACGAAAAGGCGGTTTTGGTGAA
TAACATCACCACAGGTGAGAGGCTCATCCGAGTGCTGCAAGACCAGTTAAAGACCCTGCAGA
GGAATTACGGCAGGCTGCAGCAGGATGTCCTCCAGTTTCAGAAGAACCAGACCAACCTGGAG
AGGAAGTTCTCCTACGACCTGAGCCAGTGCATCAATCAGATGAAGGAGGTGAAGGAACAGTG
TGAGGAGCGAATAGAAGAGGTCACCAAAAAGGGGAATGAAGCTGTAGCTTCCAGAGACCTGA
GTGAAAACAACGACCAGAGACAGCAGCTCCAAGCCCTCAGTGAGCCTCAGCCCAGGCTGCAG
GCAGCAGGCCTGCCACACACAGAGGTGCCACAAGGGAAGGGAAACGTGCTTGGTAACAGCAA
GTCCCAGACACCAGCCCCCAGTTCCGAAGTGGTTTTGGATTCAAAGAGACAAGTTGAGAAAG
AGGAAACCAATGAGATCCAGGTGGTGAATGAGGAGCCTCAGAGGGACAGGCTGCCGCAGGAG
CCAGGCCGGGAGCAGGTGGTGGAAGACAGACCTGTAGGTGGAAGAGGCTTCGGGGGAGCCGG
AGAACTGGGCCAGACCCCACAGGTGCAGGCTGCCCTGTCAGTGAGCCAGGAAAATCCAGAGA
TGGAGGGCCCTGAGCGAGACCAGCTTGTCATCCCCGACGGACAGGAGGAGGAGCAGGAAGCT
GCCGGGGAAGGGAGAAACCAGCAGAAACTGAGAGGAGAAGATGACTACAACATGGATGAAAA
TGAAGCAGAATCTGAGACAGACAAGCAAGCAGCCCTGGCAGGGAATGACAGAAACATAGATG
TTTTTAATGTTGAAGATCAGAAAAGAGACACCATAAATTTACTTGATCAGCGTGAAAAGCGG
AATCATACACTCTGAATTGAACTGGAATCACATATTTCACAACAGGGCCGAAGAGATGACTA
TAAAATGTTCATGAGGGACTGAATACTGAAAACTGTGAAATGTACTAAATAAAATGTACATCTGA

FIGURE 58

MMGLGNGRRSMKSPPLVLAALVACIIVLGFNYWIASSRSVDLQTRIMELEGRVRRAAAERGA
VELKKNEFQGELEKQREQLDKIQSSHNFQLESVNKLYQDEKAVLVNNITTGERLIRVLQDQL
KTLQRNYGRLQQDVLQFQKNQTNLERKFSYDLSQCINQMKEVKEQCEERIEEVTKKGNEAVA
SRDLSENNDQRQQLQALSEPQPRLQAAGLPHTEVPQGKGNVLGNSKSQTPAPSSEVVLDSKR
QVEKEETNEIQVVNEEPQRDRLPQEPGREQVVEDRPVGGRGFGGAGELGQTPQVQAALSVSQ
ENPEMEGPERDQLVIPDGQEEEQEAAGEGRNQQKLRGEDDYNMDENEAESETDKQAALAGND
RNIDVFNVEDQKRDTINLLDQREKRNHTL

Signal peptide:
amino acids 1-29

FIGURE 59

```
GGATGCAGAAAGCCTCAGTGTTGCTCTTCCTGGCCTGGGTCTGCTTCCTCTTCTACGCTGGCATTGCCCTCTTCA
CCAGTGGCTTCCTGCTCACCCGTTTGGAGCTCACCAACCATAGCAGCTGCCAAGAGCCCCCAGGCCCTGGGTCCC
TGCCATGGGGGAGCCAAGGGAAACCTGGGGCCTGCTGGATGGCTTCCCGATTTTCGCGGGTTGTGTTGGTGCTGA
TAGATGCTCTGCGATTTGACTTCGCCCAGCCCCAGCATTCACACGTGCCTAGAGAGCCTCCTGTCTCCCTACCCT
TCCTGGGCAAACTAAGCTCCTTGCAGAGGATCCTGGAGATTCAGCCCCACCATGCCCGGCTCTACCGATCTCAGG
TTGACCCTCCTACCACCACCATGCAGCGCCTCAAGGCCCTCACCACTGGCTCACTGCCTACCTTTATTGATGCTG
GTAGTAACTTCGCCAGCCACGCCATAGTGGAAGACAATCTCATTAAGCAGCTCACCAGTGCAGGAAGGCGTGTAG
TCTTCATGGGAGATGATACCTGGAAAGACCTTTTCCCTGGTGCTTTCTCCAAAGCTTTCTTCTTCCCATCCTTCA
ATGTCAGAGACCTAGACACAGTGGACAATGGCATCCTGGAACACCTCTACCCCACCATGGACAGTGGTGAATGGG
ACGTGCTGATTGCTCACTTCCTGGGTGTGGACCACTGTGGCCACAAGCATGGCCCTCACCACCCTGAAATGGCCA
AGAAACTTAGCCAGATGGACCAGGTGATCCAGGGACTTGTGGAGCGTCTGGAGAATGACACACTGCTGGTAGTGG
CTGGGGACCATGGGATGACCACAAATGGAGACCATGGAGGGGACAGTGAGCTGGAGGTCTCAGCTGCTCTCTTTC
TGTATAGCCCCACAGCAGTCTTCCCCAGCACCCCACCAGAGGAGCCAGAGGTGATTCCTCAAGTTAGCCTTGTGC
CCACGCTGGCCCTGCTGCTGGGCCTGCCCATCCCATTTGGGAATATCGGGGAAGTGATGGCTGAGCTATTCTCAG
GGGGTGAGGACTCCCAGCCCCACTCCTCTGCTTTAGCCCAAGCCTCAGCTCTCCATCTCAATGCTCAGCAGGTGT
CCCGATTTCTTCATACCTACTCAGCTGCTACTCAGGACCTTCAAGCTAAGGAGCTTCATCAGCTGCAGAACCTCT
TCTCCAAGGCCTCTGCTGACTACCAGTGGCTTCCAGAGCCCCAAGGGGGCTGAGGCGACACTGCCGACTGTGA
TTGCTGAGCTGCAGCAGTTCCTGCGGGGAGCTCGGGCCATGTGCATCGAGTCTTGGGCTCGTTTCTCTCTGGTCC
GCATGGCGGGGGGTACTGCTCTCTTGGCTGCTTCCTGCTTTATCTGCCTGCTGGCATCTCAGTGGGCAATATCCC
CAGGCTTTCCATTCTGCCCTCTACTCCTGACACCTGTGGCCTGGGGCCTGGTTGGGGCCATAGCGTATGCTGGAC
TCCTGGGAACTATTGAGCTGAAGCTAGATCTAGTGCTTCTAGGGGCTGTGGCTGCAGTGAGCTCATTCCTCCCTT
TTCTGTGGAAAGCCTGGGCTGGCTGGGGGTCCAAGAGGCCCCTGGCAACCCTGTTTCCCATCCCTGGGCCCGTCC
TGTTACTCCTGCTGTTTCGCTTGGCTGTGTTCTTCTCTGATAGTTTTGTTGTAGCTGAGGCCAGGGCCACCCCCT
TCCTTTTGGGCTCATTCATCCTGCTCCTGGTTGTCCAGCTTCACTGGGAGGGCCAGCTGCTTCCACCTAAGCTAC
TCACAATGCCCCGCCTTGGCACTTCAGCCACAACAAACCCCCACGGCACAATGGTGCATATGCCCTGAGGCTTG
GAATTGGGTTGCTTTTATGTACAAGGCTAGCTGGGCTTTTTCATCGTTGCCCTGAAGAGACACCTGTTTGCCACT
CCTCTCCCTGGCTGAGTCCTCTGGCATCCATGGTGGGTGGTCGAGCCAAGAATTTATGGTATGGAGCTTGTGTGG
CGGCGCTGGTGGCCCTGTTAGCTGCCGTGCGCTTGTGGCTTCGCCGCTATGGTAATCTCAAGAGCCCCGAGCCAC
CCATGCTCTTTGTGCGCTGGGGACTGCCCCTAATGGCATTGGGTACTGCTGCCTACTGGGCATTGGCGTCGGGGG
CAGATGAGGCTCCCCCCCGTCTCCGGGTCCTGGTCTCTGGGGCATCCATGGTGCTGCCTCGGGCTGTAGCAGGGC
TGGCTGCTTCAGGGCTCGCGCTGCTGCTCTGGAAGCCTGTGACAGTGCTGGTGAAGGCTGGGGCAGGCGCTCCAA
GGACCAGGACTGTCCTCACTCCCTTCTCAGGGCCCCCCACTTCTCAAGCTGACTTGGATTATGTGGTCCCTCAAA
TCTACCGACACATGCAGGAGGAGTTCCGGGGCCGGTTAGAGAGGACCAAATCTCAGGGTCCCCCTGACTGTGGCTG
CTTATCAGTTGGGGAGTGTCTACTCAGCTGCTATGGTCACAGCCCTCACCCTGTTGGCCTTCCCACTTCTGCTGT
TGCATGCGGAGCGCATCAGCCTTGTGTTCCTGCTTCTGTTTCTGCAGAGCTTCCTTCTCCTACATCTGCTTGCTG
CTGGGATACCCGTCACCACCCCTGGTCCTTTTACTGTGCCATGGCAGGCAGTCTCGGCTTGGGCCCTCATGGCCA
CACAGACCTTCTACTCCACAGGCCACCAGCCTGTCTTTCCAGCCATCCATTGGCATGCAGCCTTCGTGGGATTCC
CAGAGGGTCATGGCTCCTGTACTTGGCTGCCTGCTTTGCTAGTGGGAGCCAACACCTTTGCCTCCCACCTCCTCT
TTGCAGTAGGTTGCCCACTGCTCCTGCTCTGGCCTTTCCTGTGTGAGAGTCAAGGGCTGCGGAAGAGACAGCAGC
CCCCAGGGAATGAAGCTGATGCCAGAGTCAGACCCGAGGAGGAAGAGGAGCCACTGATGGAGATGCGGCTCCGGG
ATGCGCCTCAGCACTTCTATGCAGCACTGCTGCAGCTGGGCCTCAAGTACCTCTTTATCCTTGGTATTCAGATTC
TGGCCTGTGCCTTGGCAGCCTCCATCCTTCGCAGGCATCTCATGGTCTGGAAAGTGTTTGCCCCTAAGTTCATAT
TTGAGGCTGTGGGCTTCATTGTGAGCAGCGTGGGACTTCTCCTGGGCATAGCTTTGGTGATGAGAGTGGATGGTG
CTGTGAGCTCCTGGTTCAGGCAGCTATTTCTGGCCCAGCAGAGGTAGCCTAGTCTGTGATTACTGGCACTTGGCT
ACAGAGAGTGCTGGAGAACAGTGTAGCCTGGCCTGTACAGGTACTGGATGATCTGCAAGACAGGCTCAGCCATAC
TCTTACTATCATGCAGCCAGGGGCCGCTGACATCTAGGACTTCATTATTCTATAATTCAGGACCACAGTGGAGTA
TGATCCCTAACTCCTGATTTGGATGCATCTGAGGGACAAGGGGGCGGTCTCCGAAGTGGAATAAAATAGGCCGG
GCGTGGTGACTTGCACCTATAATCCCAGCACTTTGGGAGGCAGAGGTGGGAGGATTGCTTGGTCCCAGGAGTTCA
AGACCAGCCTGTGGAACATAACAAGACCCCGTCTCTACTATTTAAAAAAAAGTGTAATAAAATGATAATAT
```

FIGURE 60

```
</usr/seqdb2/sst/DNA/Dnaseqs.min/ss.DNA62809
<subunit 1 of 1, 1089 aa, 1 stop
<MW: 118699, pI: 8.49, NX(S/T): 2
MQKASVLLFLAWVCFLFYAGIALFTSGFLLTRLELTNHSSCQEPPGPGSLPWGSQGKPGACW
MASRFSRVVLVLIDALRFDFAQPQHSHVPREPPVSLPFLGKLSSLQRILEIQPHHARLYRSQ
VDPPTTTMQRLKALTTGSLPTFIDAGSNFASHAIVEDNLIKQLTSAGRRVVFMGDDTWKDLF
PGAFSKAFFFPSFNVRDLDTVDNGILEHLYPTMDSGEWDVLIAHFLGVDHCGHKHGPHHPEM
AKKLSQMDQVIQGLVERLENDTLLVVAGDHGMTTNGDHGGDSELEVSAALFLYSPTAVFPST
PPEEPEVIPQVSLVPTLALLLGLPIPFGNIGEVMAELFSGGEDSQPHSSALAQASALHLNAQ
QVSRFLHTYSAATQDLQAKELHQLQNLFSKASADYQWLLQSPKGAEATLPTVIAELQQFLRG
ARAMCIESWARFSLVRMAGGTALLAASCFICLLASQWAISPGFPFCPLLLTPVAWGLVGAIA
YAGLLGTIELKLDLVLLGAVAAVSSFLPFLWKAWAGWGSKRPLATLFPIPGPVLLLLLFRLA
VFFSDSFVVAEARATPFLLGSFILLLVVQLHWEGQLLPPKLLTMPRLGTSATTNPPRHNGAY
ALRLGIGLLLCTRLAGLFHRCPEETPVCHSSPWLSPLASMVGGRAKNLWYGACVAALVALLA
AVRLWLRRYGNLKSPEPPMLFVRWGLPLMALGTAAYWALASGADEAPPRLRVLVSGASMVLP
RAVAGLAASGLALLLWKPVTVLVKAGAGAPRTRTVLTPFSGPPTSQADLDYVVPQIYRHMQE
EFRGRLERTKSQGPLTVAAYQLGSVYSAAMVTALTLLAFPLLLHAERISLVFLLLFLQSFL
LLHLLAAGIPVTTPGPFTVPWQAVSAWALMATQTFYSTGHQPVFPAIHWHAAFVGFPEGHGS
CTWLPALLVGANTFASHLLFAVGCPLLLLWPFLCESQGLRKRQQPPGNEADARVRPEEEEEP
LMEMRLRDAPQHFYAALLQLGLKYLFILGIQILACALAASILRRHLMVWKVFAPKFIFEAVG
FIVSSVGLLLGIALVMRVDGAVSSWFRQLFLAQQR
```

Important features:

Signal peptide:
amino acids 1-16

Transmembrane domains:
amino acids 317-341, 451-470, 481-500, 510-527, 538-555, 831-850, 1016-1034, 1052-1070

Leucine zipper pattern.
amino acids 843-864

N-glycosylation sites.
amino acids 37-40, 268-271

FIGURE 61

TGCCGCTGCCGCCGCTGCTGCTGTTGCTCCTGGCGGCGCCTTGGGGACGGGCAGTTCCCTGT
GTCTCTGGTGGTTTGCCTAAACCTGCAAACATCACCTTCTTATCCATCAACATGAAGAATGT
CCTACAATGGACTCCACCAGAGGGTCTTCAAGGAGTTAAAGTTACTTACACTGTGCAGTATT
TCATCACAAATTGGCCCACCAGAGGTGGCACTGACTACAGATGAGAAGTCCATTTCTGTTGT
CCTGACAGCTCCAGAGAAGTGGAAGAGAAATCCAGAAGACCTTCCTGTTTCCATGCAACAAA
TATACTCCAATCTGAAGTATAACGTGTCTGTGTTGAATACTAAATCAAACAGAACGTGGTCC
CAGTGTGTGACCAACCACACGCTGGTGCTCACCTGGCTGGAGCCGAACACTCTTTACTGCGT
ACACGTGGAGTCCTTCGTCCCAGGGCCCCCTCGCCGTGCTCAGCCTTCTGAGAAGCAGTGTG
CCAGGACTTTGAAAGATCAATCATCAGAGTTCAAGGCTAAAATCATCTTCTGGTATGTTTTG
CCCATATCTATTACCGTGTTTCTTTTTCTGTGATGGGCTATTCCATCTACCGATATATCCA
CGTTGGCAAAGAGAAACACCCAGCAAATTTGATTTTGATTTATGGAAATGAATTTGACAAAA
GATTCTTTGTGCCTGCTGAAAAAATCGTGATTAACTTTATCACCCTCAATATCTCGGATGAT
TCTAAAATTTCTCATCAGGATATGAGTTTACTGGGAAAAAGCAGTGATGTATCCAGCCTTAA
TGATCCTCAGCCCAGCGGGAACCTGAGGCCCCCTCAGGAGGAAGAGGAGGTGAAACATTTAG
GGTATGCTTCGCATTTGATGGAATTTTTTGTGACTCTGAAGAAAACACGGAAGGTACTTCT
CTCACCCAGCAAGAGTCCCTCAGCAGAACAATACCCCGGATAAAACAGTCATTGAATATGA
ATATGATGTCAGAACCACTGACATTTGTGCGGGCCTGAAGAGCAGGAGCTCAGTTTGCAGG
AGGAGGTGTCCACACAAGGAACATTATTGGAGTCGCAGGCAGCGTTGGCAGTCTTGGGCCCG
CAAACGTTACAGTACTCATACACCCCTCAGCTCCAAGACTTAGACCCCCTGGCGCAGGAGCA
CACAGACTCGGAGGAGGGGCCGGAGGAAGAGCCATCGACGACCCTGGTCGACTGGGATCCCC
AAACTGGCAGGCTGTGTATTCCTTCGCTGTCCAGCTTCGACCAGGATTCAGAGGGCTGCGAG
CCTTCTGAGGGGGATGGGCTCGGAGAGGAGGGTCTTCTATCTAGACTCTATGAGGAGCCGGC
TCCAGACAGGCCACCAGGAGAAAATGAAACCTATCTCATGCAATTCATGGAGGAATGGGGT
TATATGTGCAGATGGAAAACTGATGCCAACACTTCCTTTTGCCTTTTGTTTCCTGTGCAAAC
AAGTGAGTCACCCCTTTGATCCCAGCCATAAAGTACCTGGGATGAAAGAAGTTTTTTCCAGT
TTGTCAGTGTCTGTGAGAATTACTTATTTCTTTTCTCTATTCTCATAGCACGTGTGTGATTG
GTTCATGCATGTAGGTCTCTTAACAATGATGGTGGGCCTCTGGAGTCCAGGGGCTGGCCGGT
TGTTCTATGCAGAGAAAGCAGTCAATAAATGTTTGCCAGACTGGGTGCAGAATTTATTCAGG
TGGGTGT

FIGURE 62

```
</usr/seqdb2/sst/DNA/Dnaseqs.min/ss.DNA62815
<subunit 1 of 1, 442 aa, 1 stop
<MW: 49932, pI: 4.55, NX(S/T): 5
MSYNGLHQRVFKELKLLTLCSISSQIGPPEVALTTDEKSISVVLTAPEKWKRNPEDLPVSMQ
QIYSNLKYNVSVLNTKSNRTWSQCVTNHTLVLTWLEPNTLYCVHVESFVPGPPRRAQPSEKQ
CARTLKDQSSEFKAKIIFWYVLPISITVFLFSVMGYSIYRYIHVGKEKHPANLILIYGNEFD
KRFFVPAEKIVINFITLNISDDSKISHQDMSLLGKSSDVSSLNDPQPSGNLRPPQEEEEVKH
LGYASHLMEIFCDSEENTEGTSLTQQESLSRTIPPDKTVIEYEYDVRTTDICAGPEEQELSL
QEEVSTQGTLLESQAALAVLGPQTLQYSYTPQLQDLDPLAQEHTDSEEGPEEEPSTTLVDWD
PQTGRLCIPSLSSFDQDSEGCEPSEGDGLGEEGLLSRLYEEPAPDRPPGENETYLMQFMEEW
GLYVQMEN
```

Important features:

Signal peptide:

amino acids 1-28

Transmembrane domain:

amino acids 140-163

N-glycosylation sites.

amino acids 71-74, 80-83, 89-92, 204-207, 423-426

FIGURE 63

CGGACGCGTGGGCGGACGCGTGGGCGGACGCGTGGGTCTCTGCGGGGAGACGCCAGCCTGCG
TCTGCCATGGGGCTCGGGTTGAGGGGCTGGGGACGTCCTCTGCTGACTGTGGCCACCGCCCT
GATGCTGCCCGTGAAGCCCCCGCAGGCTCCTGGGGGCCCAGATCATCGGGGGCCACGAGG
TGACCCCCACTCCAGGCCCTACATGGCATCCGTGCGCTTCGGGGGCCAACATCACTGCGGA
GGCTTCCTGCTGCGAGCCCGCTGGGTGGTCTCGGCCGCCCACTGCTTCAGCCACAGAGACCT
CCGCACTGGCCTGGTGGTGCTGGGCGCCCACGTCCTGAGTACTGCGGAGCCCACCCAGCAGG
TGTTTGGCATCGATGCTCTCACCACGCACCCCGACTACCACCCCATGACCCACGCCAACGAC
ATCTGCCTGCTGCGGCTGAACGGCTCTGCTGTCCTGGGCCCTGCAGTGGGGCTGCTGAGGCT
GCCAGGGAGAAGGGCCAGGCCCCCCACAGCGGGGACACGGTGCCGGGTGGCTGGCTGGGGCT
TCGTGTCTGACTTTGAGGAGCTGCCGCCTGGACTGATGGAGGCCAAGGTCCGAGTGCTGGAC
CCGGACGTCTGCAACAGCTCCTGGAAGGGCCACCTGACACTTACCATGCTCTGCACCCGCAG
TGGGGACAGCCACAGACGGGGCTTCTGCTCGGCCGACTCCGGAGGGCCCCTGGTGTGCAGGA
ACCGGGCTCACGGCCTCGTTTCCTTCTCGGGCCTCTGGTGCGGCGACCCCAAGACCCCCGAC
GTGTACACGCAGGTGTCCGCCTTTGTGGCCTGGATCTGGGACGTGGTTCGGCGGAGCAGTCC
CCAGCCCGGCCCCCTGCCTGGGACCACCAGGCCCCCAGGAGAAGCCGCCTGAGCCACAACCT
TGCGGCATGCAAATGAGATGGCCGCTCCAGGCCTGGAATGTTCCGTGGCTGGGCCCCACGGG
AAGCCTGATGTTCAGGGTTGGGGTGGGACGGGCAGCGGTGGGGCACACCCATTCCACATGCA
AAGGGCAGAAGCAAACCCAGTAAAATGTTAACTGACAAAAAAAAAAAAAAAAAAAAGAAA

FIGURE 64

></usr/seqdb2/sst/DNA/Dnaseqs.min/ss.DNA62845
><subunit 1 of 1, 283 aa, 1 stop
><MW: 30350, pI: 9.66, NX(S/T): 2
MGLGLRGWGRPLLTVATALMLPVKPPAGSWGAQIIGGHEVTPHSRPYMASVRFGGQHHCGGF
LLRARWVVSAAHCFSHRDLRTGLVVLGAHVLSTAEPTQQVFGIDALTTHPDYHPMTHANDIC
LLRLNGSAVLGPAVGLLRLPGRRARPPTAGTRCRVAGWGFVSDFEELPPGLMEAKVRVLDPD
VCNSSWKGHLTLTMLCTRSGDSHRRGFCSADSGGPLVCRNRAHGLVSFSGLWCGDPKTPDVY
TQVSAFVAWIWDVVRRSSPQPGPLPGTTRPPGEAA

Signal peptide:

amino acids 1-30

FIGURE 65

GAGCTACCCAGGCGGCTGGTGTGCAGCAAGCTCCGCGCCGACTCCGGACGCCTGACGCCTGA
CGCCTGTCCCCGGCCCGGCATGAGCCGCTACCTGCTGCCGCTGTCGGCGCTGGGCACGGTAG
CAGGCGCCGCCGTGCTGCTCAAGGACTATGTCACCGGTGGGGCTTGCCCCAGCAAGGCCACC
ATCCCTGGGAAGACGGTCATCGTGACGGGCGCCAACACAGGCATCGGGAAGCAGACCGCCTT
GGAACTGGCCAGGAGAGGAGGCAACATCATCCTGGCCTGCCGAGACATGGAGAAGTGTGAGG
CGGCAGCAAAGGACATCCGCGGGGAGACCCTCAATCACCATGTCAACGCCCGGCACCTGGAC
TTGGCTTCCCTCAAGTCTATCCGAGAGTTTGCAGCAAAGATCATTGAAGAGGAGGAGCGAGT
GGACATTCTAATCAACAACGCGGGTGTGATGCGGTGCCCCACTGGACCACCGAGGACGGCT
TCGAGATGCAGTTTGGCGTTAACCACCTGGGTCACTTTCTCTTGACAAACTTGCTGCTGGAC
AAGCTGAAAGCCTCAGCCCCTTCGCGGATCATCAACCTCTCGTCCCTGGCCCATGTTGCTGG
GCACATAGACTTTGACGACTTGAACTGGCAGACGAGGAAGTATAACACCAAAGCCGCCTACT
GCCAGAGCAAGCTCGCCATCGTCCTCTTCACCAAGGAGCTGAGCCGGCGGCTGCAAGGCTCT
GGTGTGACTGTCAACGCCCTGCACCCCGGCGTGGCCAGGACAGAGCTGGGCAGACACACGGG
CATCCATGGCTCCACCTTCTCCAGCACCACACTCGGGCCCATCTTCTGGCTGCTGGTCAAGA
GCCCCGAGCTGGCCGCCCAGCCCAGCACATACCTGGCCGTGGCGGAGGAACTGGCGGATGTT
TCCGGAAAGTACTTCGATGGACTCAAACAGAAGGCCCCGGCCCCCGAGGCTGAGGATGAGGA
GGTGGCCCGGAGGCTTTGGGCTGAAAGTGCCCGCCTGGTGGGCTTAGAGGCTCCCTCTGTGA
GGGAGCAGCCCCTCCCCAGATAACCTCTGGAGCAGATTTGAAAGCCAGGATGGCGCCTCCAG
ACCGAGGACAGCTGTCCGCCATGCCCGCAGCTTCCTGGCACTACCTGAGCCGGGAGACCCAG
GACTGGCGGCCGCCATGCCCGCAGTAGGTTCTAGGGGGCGGTGCTGGCCGCAGTGGACTGGC
CTGCAGGTGAGCACTGCCCCGGGCTCTGGCTGGTTCCGTCTGCTCTGCTGCCAGCAGGGGAG
AGGGGCCATCTGATGCTTCCCCTGGGAATCTAAACTGGGAATGGCCGAGGAGGAAGGGGCTC
TGTGCACTTGCAGGCCACGTCAGGAGAGCCAGCGGTGCCTGTCGGGAGGGTTCCAAGGTGC
TCCGTGAAGAGCATGGGCAAGTTGTCTGACACTTGGTGGATTCTTGGGTCCCTGTGGGACCT
TGTGCATGCATGGTCCTCTCTGAGCCTTGGTTTCTTCAGCAGTGAGATGCTCAGAATAACTG
CTGTCTCCCATGATGGTGTGGTACAGCGAGCTGTTGTCTGGCTATGGCATGGCTGTGCCGGG
GGTGTTTGCTGAGGGCTTCCTGTGCCAGAGCCCAGCCAGAGAGCAGGTGCAGGTGTCATCCC
GAGTTCAGGCTCTGCACGGCATGGAGTGGGAACCCCACCAGCTGCTGCTACAGGACCTGGGA
TTGCCTGGGACTCCCACCTTCCTATCAATTCTCATGGTAGTCCAAACTGCAGACTCTCAAAC
TTGCTCATTT

FIGURE 66

```
></usr/seqdb2/sst/DNA/Dnaseqs.min/ss.DNA64842
><subunit 1 of 1, 331 aa, 1 stop
><MW: 35932, pI: 8.45, NX(S/T): 1
MSRYLLPLSALGTVAGAAVLLKDYVTGGACPSKATIPGKTVIVTGANTGIGKQTALELARRG
GNIILACRDMEKCEAAAKDIRGETLNHHVNARHLDLASLKSIREFAAKIIEEEERVDILINN
AGVMRCPHWTTEDGFEMQFGVNHLGHFLLTNLLLDKLKASAPSRIINLSSLAHVAGHIDFDD
LNWQTRKYNTKAAYCQSKLAIVLFTKELSRRLQGSGVTVNALHPGVARTELGRHTGIHGSTF
SSTTLGPIFWLLVKSPELAAQPSTYLAVAEELADVSGKYFDGLKQKAPAPEAEDEEVARRLW
AESARLVGLEAPSVREQPLPR
```

Signal peptide:
amino acids 1-17

FIGURE 67

```
GAAGTTCGCGAGCGCTGGCATGTGGTCCTGGGGCGCGGCTGGCGGCGCTGCTGGCGGTGCTG
GCGCTCGGGACAGGAGACCCAGAAAGGGCTGCGGCTCGGGCGACACGTTCTCGGCGCTGAC
CAGCGTGGCGCGCGCCCTGGCGCCCGAGCGCCGGCTGCTGGGGCTGCTGAGGCGGTACCTGC
GCGGGGAGGAGGCGCGGCTGCGGGACCTGACTAGATTCTACGACAAGGTACTTTCTTTGCAT
GAGGATTCAACAACCCCTGTGGCTAACCCTCTGCTTGCATTTACTCTCATCAAACGCCTGCA
GTCTGACTGGAGGAATGTGGTACATAGTCTGGAGGCCAGTGAGAACATCCGAGCTCTGAAGG
ATGGCTATGAGAAGGTGGAGCAAGACCTTCCAGCCTTTGAGGACCTTGAGGGAGCAGCAAGG
GCCCTGATGCGGCTGCAGGACGTGTACATGCTCAATGTGAAAGGCCTGGCCCGAGGTGTCTT
TCAGAGAGTCACTGGCTCTGCCATCACTGACCTGTACAGCCCCAAACGGCTCTTTTCTCTCA
CAGGGGATGACTGCTTCCAAGTTGGCAAGGTGGCCTATGACATGGGGGATTATTACCATGCC
ATTCCATGGCTGGAGGAGGCTGTCAGTCTCTTCCGAGGATCTTACGGAGAGTGGAAGACAGA
GGATGAGGCAAGTCTAGAAGATGCCTTGGATCACTTGGCCTTTGCTTATTTCCGGGCAGGAA
ATGTTTCGTGTGCCCTCAGCCTCTCTCGGGAGTTTCTTCTCTACAGCCCAGATAATAAGAGG
ATGGCCAGGAATGTCTTGAAATATGAAAGGCTCTTGGCAGAGAGCCCCAACCACGTGGTAGC
TGAGGCTGTCATCCAGAGGCCCAATATACCCCACCTGCAGACCAGAGACACCTACGAGGGGC
TATGTCAGACCCTGGGTTCCCAGCCCACTCTCTACCAGATCCCTAGCCTCTACTGTTCCTAT
GAGACCAATTCCAACGCCTACCTGCTGCTCCAGCCCATCCGGAAGGAGGTCATCCACCTGGA
GCCCTACATTGCTCTCTACCATGACTTCGTCAGTGACTCAGAGGCTCAGAAAATTAGAGAAC
TTGCAGAACCATGGCTACAGAGGTCAGTGGTGGCATCAGGGGAGAAGCAGTTACAAGTGGAG
TACCGCATCAGCAAAAGTGCCTGGCTGAAGGACACTGTTGACCCAAAACTGGTGACCCTCAA
CCACCGCATTGCTGCCCTCACAGGCCTTGATGTCCGGCCTCCCTATGCAGAGTATCTGCAGG
TGGTGAACTATGGCATCGGAGGACACTATGAGCCTCACTTTGACCATGCTACGTCACCAAGC
AGCCCCCTCTACAGAATGAAGTCAGGAAACCGAGTTGCAACATTTATGATCTATCTGAGCTC
GGTGGAAGCTGGAGGAGCCACAGCCTTCATCTATGCCAACCTCAGCGTGCCTGTGGTTAGGA
ATGCAGCACTGTTTTGGTGGAACCTGCACAGGAGTGGTGAAGGGGACAGTGACACACTTCAT
GCTGGCTGTCCTGTCCTGGTGGGAGATAAGTGGGTGGCCAACAAGTGGATACATGAGTATGG
ACAGGAATTCCGCAGACCCTGCAGCTCCAGCCCTGAAGACTGAACTGTTGGCAGAGAGAAGC
TGGTGGAGTCCTGTGGCTTTCCAGAGAAGCCAGGAGCCAAAAGCTGGGGTAGGAGAGGAGAA
AGCAGAGCAGCCTCCTGGAAGAAGGCCTTGTCAGCTTTGTCTGTGCCTCGCAAATCAGAGGC
AAGGGAGAGGTTGTTACCAGGGGACACTGAGAATGTACATTTGATCTGCCCCAGCCACGGAA
GTCAGAGTAGGATGCACAGTACAAAGGAGGGGGAGTGGAGGCCTGAGAGGGAAGTTTCTGG
AGTTCAGATACTCTCTGTTGGGAACAGGACATCTCAACAGTCTCAGGTTCGATCAGTGGGTC
TTTTGGCACTTTGAACCTTGACCACAGGGACCAAGAAGTGGCAATGAGGACACCTGCAGGAG
GGGCTAGCCTGACTCCCAGAACTTTAAGACTTTCTCCCCACTGCCTTCTGCTGCAGCCCAAG
CAGGGAGTGTCCCCCTCCCAGAAGCATATCCCAGATGAGTGGTACATTATATAAGGATTTTT
TTTAAGTTGAAAACAACTTTCTTTTCTTTTGTATGATGGTTTTTTAACACAGTCATTAAAA
ATGTTTATAAATCAAAA
```

FIGURE 68

MGPGARLAALLAVLALGTGDPERAAARGDTFSALTSVARALAPERRLLGLLRRYLRGEEARL
RDLTRFYDKVLSLHEDSTTPVANPLLAFTLIKRLQSDWRNVVHSLEASENIRALKDGYEKVE
QDLPAFEDLEGAARALMRLQDVYMLNVKGLARGVFQRVTGSAITDLYSPKRLFSLTGDDCFQ
VGKVAYDMGDYYHAIPWLEEAVSLFRGSYGEWKTEDEASLEDALDHLAFAYFRAGNVSCALS
LSREFLLYSPDNKRMARNVLKYERLLAESPNHVVAEAVIQRPNIPHLQTRDTYEGLCQTLGS
QPTLYQIPSLYCSYETNSNAYLLLQPIRKEVIHLEPYIALYHDFVSDSEAQKIRELAEPWLQ
RSVVASGEKQLQVEYRISKSAWLKDTVDPKLVTLNHRIAALTGLDVRPPYAEYLQVVNYGIG
GHYEPHFDHATSPSSPLYRMKSGNRVATFMIYLSSVEAGGATAFIYANLSVPVVRNAALFWW
NLHRSGEGDSDTLHAGCPVLVGDKWVANKWIHEYGQEFRRPCSSSPED

Signal peptide:
amino acids 1-19

FIGURE 69

```
GAGATAGGGAGTCTGGGTTTAAGTTCCTGCTCCATCTCAGGAGCCCCTGCTCCCACCCCTAG
GAAGCCACCAGACTCCACGGTGTGGGGCCAATCAGGTGGAATCGGCCCTGGCAGGTGGGGCC
ACGAGCGCTGGCTGAGGGACCGAGCCGGAGAGCCCCGGAGCCCCCGTAACCCGCGCGGGGAG
CGCCCAGGATGCCGCGCGGGGACTCGGAGCAGGTGCGCTACTGCGCGCGCTTCTCCTACCTC
TGGCTCAAGTTTTCACTTATCATCTATTCCACCGTGTTCTGGCTGATTGGGGCCCTGGTCCT
GTCTGTGGGCATCTATGCAGAGGTTGAGCGGCAGAAATATAAAACCCTTGAAAGTGCCTTCC
TGGCTCCAGCCATCATCCTCATCCTCCTGGGCGTCGTCATGTTCATGGTCTCCTTCATTGGT
GTGCTGGCGTCCCTCCGTGACAACCTGTACCTTCTCCAAGCATTCATGTACATCCTTGGGAT
CTGCCTCATCATGGAGCTCATTGGTGGCGTGGTGGCCTTGACCTTCCGGAACCAGACCATTG
ACTTCCTGAACGACAACATTCGAAGAGGAATTGAGAACTACTATGATGATCTGGACTTCAAA
AACATCATGGACTTTGTTCAGAAAAAGTTCAAGTGCTGTGGCGGGGAGGACTACCGAGATTG
GAGCAAGAATCAGTACCACGACTGCAGTGCCCCTGGACCCCTGGCCTGTGGGGTGCCCTACA
CCTGCTGCATCAGGAACACGACAGAAGTTGTCAACACCATGTGTGGCTACAAAACTATCGAC
AAGGAGCGTTTCAGTGTGCAGGATGTCATCTACGTGCGGGGCTGCACCAACGCCGTGATCAT
CTGGTTCATGGACAACTACACCATCATGGCGTGCATCCTCCTGGGCATCCTGCTTCCCCAGT
TCCTGGGGGTGCTGCTGACGCTGCTGTACATCACCCGGGTGGAGGACATCATCATGGAGCAC
TCTGTCACTGATGGGCTCCTGGGGCCCGGTGCCAAGCCCAGCGTGGAGGCGGCAGGCACGGG
ATGCTGCTTGTGCTACCCCAATTAGGGCCCAGCCTGCCATGGCAGCTCCAACAAGGACCGTC
TGGGATAGCACCTCTCAGTCAACATCGTGGGGCTGGACAGGGCTGCGGCCCCTCTGCCCACA
CTCAGTACTGACCAAAGCCAGGGCTGTGTGTGCCTGTGTGTAGGTCCCACGGCCTCTGCCTC
CCCAGGGAGCAGAGCCTGGGCCTCCCCTAAGAGGCTTTCCCCGAGGCAGCTCTGGAATCTGT
GCCCACCTGGGGCCTGGGGAACAAGGCCCTCCTTTCTCCAGGCCTGGGCTACAGGGGAGGGA
GAGCCTGAGGCTCTGCTCAGGGCCCATTTCATCTCTGGCAGTGCCTTGGCGGTGGTATTCAA
GGCAGTTTTGTAGCACCTGTAATTGGGGAGAGGGAGTGTGCCCCTCGGGGCAGGAGGGAAGG
GCATCTGGGGAAGGGCAGGAGGGAAGAGCTGTCCATGCAGCCACGCCCATGGCCAGGTTGGC
CTCTTCTCAGCCTCCCAGGTGCCTTGAGCCCTCTTGCAAGGGCGGCTGCTTCCTTGAGCCTA
GTTTTTTTTTACGTGATTTTTGTAACATTCATTTTTTTGTACAGATAACAGGAGTTTCTGAC
TAATCAAAGCTGGTATTTCCCCGCATGTCTTATTCTTGCCCTTCCCCCAACCAGTTTGTTAA
TCAAACAATAAAAACATGTTTTGTTTTGTTTTTAAAAAAAAA
```

FIGURE 70

></usr/seqdb2/sst/DNA/Dnaseqs.min/ss.DNA64863
><subunit 1 of 1, 294 aa, 1 stop
><MW: 33211, pI: 5.35, NX(S/T): 3
MPRGDSEQVRYCARFSYLWLKFSLIIYSTVFWLIGALVLSVGIYAEVERQKYKTLESAFLAP
AIILILLGVVMFMVSFIGVLASLRDNLYLLQAFMYILGICLIMELIGGVVALTFRNQTIDFL
NDNIRRGIENYYDDLDFKNIMDFVQKKFKCCGGEDYRDWSKNQYHDCSAPGPLACGVPYTCC
IRNTTEVVNTMCGYKTIDKERFSVQDVIYVRGCTNAVIIWFMDNYTIMACILLGILLPQFLG
VLLTLLYITRVEDIIMEHSVTDGLLGPGAKPSVEAAGTGCCLCYPN

Signal peptide:

amino acids 1-44

Transmembrane domains:

amino acids 22-42, 57-85, 93-116, 230-257

FIGURE 71

GAGGAGCGGGCCGAGGACTCCAGCGTGCCCAGGTCTGGCATCCTGCACTTGCTGCCCTCTGA
CACCTGGGAAGATGGCCGGCCCGTGGACCTTCACCCTTCTCTGTGGTTTGCTGGCAGCCACC
TTGATCCAAGCCACCCTCAGTCCCACTGCAGTTCTCATCCTCGGCCCAAAAGTCATCAAAGA
AAAGCTGACACAGGAGCTGAAGGACCACAACGCCACCAGCATCCTGCAGCAGCTGCCGCTGC
TCAGTGCCATGCGGGAAAAGCCAGCCGGAGGCATCCCTGTGCTGGGCAGCCTGGTGAACACC
GTCCTGAAGCACATCATCTGGCTGAAGGTCATCACAGCTAACATCCTCCAGCTGCAGGTGAA
GCCCTCGGCCAATGACCAGGAGCTGCTAGTCAAGATCCCCCTGGACATGGTGGCTGGATTCA
ACACGCCCCTGGTCAAGACCATCGTGGAGTTCCACATGACGACTGAGGCCCAAGCCACCATC
CGCATGGACACCAGTGCAAGTGGCCCCACCCGCCTGGTCCTCAGTGACTGTGCCACCAGCCA
TGGGAGCCTGCGCATCCAACTGCTGTATAAGCTCTCCTTCCTGGTGAACGCCTTAGCTAAGC
AGGTCATGAACCTCCTAGTGCCATCCCTGCCCAATCTAGTGAAAACCAGCTGTGTCCCGTG
ATCGAGGCTTCCTTCAATGGCATGTATGCAGACCTCCTGCAGCTGGTGAAGGTGCCCCATTTC
CCTCAGCATTGACCGTCTGGAGTTTGACCTTCTGTATCCTGCCATCAAGGGTGACACCATTC
AGCTCTACCTGGGGGCCAAGTTGTTGGACTCACAGGGAAAGGTGACCAAGTGGTTCAATAAC
TCTGCAGCTTCCCTGACAATGCCCACCCTGGACAACATCCCGTTCAGCCTCATCGTGAGTCA
GGACGTGGTGAAAGCTGCAGTGGCTGCTGTGCTCTCTCCAGAAGAATTCATGGTCCTGTTGG
ACTCTGTGCTTCCTGAGAGTGCCCATCGGCTGAAGTCAAGCATCGGGCTGATCAATGAAAAG
GCTGCAGATAAGCTGGGATCTACCCAGATCGTGAAGATCCTAACTCAGGACACTCCCGAGTT
TTTTATAGACCAAGGCCATGCCAAGGTGGCCCAACTGATCGTGCTGGAAGTGTTTCCCTCCA
GTGAAGCCCTCCGCCCTTTGTTCACCCTGGGCATCGAAGCCAGCTCGGAAGCTCAGTTTTAC
ACCAAAGGTGACCAACTTATACTCAACTTGAATAACATCAGCTCTGATCGGATCCAGCTGAT
GAACTCTGGGATTGGCTGGTTCCAACCTGATGTTCTGAAAAACATCATCACTGAGATCATCC
ACTCCATCCTGCTGCCGAACCAGAATGGCAAATTAAGATCTGGGGTCCCAGTGTCATTGGTG
AAGGCCTTGGGATTCGAGGCAGCTGAGTCCTCACTGACCAAGGATGCCCTTGTGCTTACTCC
AGCCTCCTTGTGGAAACCCAGCTCTCCTGTCTCCCAGTGAAGACTTGGATGGCAGCCATCAG
GGAAGGCTGGGTCCCAGCTGGGAGTATGGGTGTGAGCTCTATAGACCATCCCTCTCTGCAAT
CAATAAACACTTGCCTGTGAAAAA

FIGURE 72

></usr/seqdb2/sst/DNA/Dnaseqs.min/ss.DNA64881
><subunit 1 of 1, 484 aa, 1 stop
><MW: 52468, pI: 7.14, NX(S/T): 3
MAGPWTFTLLCGLLAATLIQATLSPTAVLILGPKVIKEKLTQELKDHNATSILQQLPLLSAM
REKPAGGIPVLGSLVNTVLKHIIWLKVITANILQLQVKPSANDQELLVKIPLDMVAGFNTPL
VKTIVEFHMTTEAQATIRMDTSASGPTRLVLSDCATSHGSLRIQLLYKLSFLVNALAKQVMN
LLVPSLPNLVKNQLCPVIEASFNGMYADLLQLVKVPISLSIDRLEFDLLYPAIKGDTIQLYL
GAKLLDSQGKVTKWFNNSAASLTMPTLDNIPFSLIVSQDVVKAAVAAVLSPEEFMVLLDSVL
PESAHRLKSSIGLINEKAADKLGSTQIVKILTQDTPEFFIDQGHAKVAQLIVLEVFPSSEAL
RPLFTLGIEASSEAQFYTKGDQLILNLNNISSDRIQLMNSGIGWFQPDVLKNIITEIIHSIL
LPNQNGKLRSGVPVSLVKALGFEAAESSLTKDALVLTPASLWKPSSPVSQ

Important features of the protein:
Signal peptide:
amino acids 1-21

N-glycosylation sites.
amino acids 48-51, 264-267, 401-404

Glycosaminoglycan attachment site.
amino acids 412-415

LBP / BPI / CETP family proteins.
amino acids 407-457

FIGURE 73

```
GAGCGAACATGGCAGCGCGTTGGCGGTTTTGGTGTGTCTCTGTGACCATGGTGGTGGCGCTG
CTCATCGTTTGCGACGTTCCCTCAGCCTCTGCCCAAAGAAAGAAGGAGATGGTGTTATCTGA
AAAGGTTAGTCAGCTGATGGAATGGACTAACAAAAGACCTGTAATAAGAATGAATGGAGACA
AGTTCCGTCGCCTTGTGAAAGCCCCACCGAGAAATTACTCCGTTATCGTCATGTTCACTGCT
CTCCAACTGCATAGACAGTGTGTCGTTTGCAAGCAAGCTGATGAAGAATTCCAGATCCTGGC
AAACTCCTGGCGATACTCCAGTGCATTCACCAACAGGATATTTTTTGCCATGGTGGATTTTG
ATGAAGGCTCTGATGTATTTCAGATGCTAAACATGAATTCAGCTCCAACTTTCATCAACTTT
CCTGCAAAAGGGAAACCCAAACGGGGTGATACATATGAGTTACAGGTGCGGGGTTTTTCAGC
TGAGCAGATTGCCCGGTGGATCGCCGACAGAACTGATGTCAATATTAGAGTGATTAGACCCC
CAAATTATGCTGGTCCCCTTATGTTGGGATTGCTTTTGGCTGTTATTGGTGGACTTGTGTAT
CTTCGAAGAAGTAATATGGAATTTCTCTTTAATAAAACTGGATGGGCTTTTGCAGCTTTGTG
TTTTGTGCTTGCTATGACATCTGGTCAAATGTGGAACCATATAAGAGGACCACCATATGCCC
ATAAGAATCCCCACACGGGACATGTGAATTATATCCATGGAAGCAGTCAAGCCCAGTTTGTA
GCTGAAACACACATTGTTCTTCTGTTTAATGGTGGAGTTACCTTAGGAATGGTGCTTTTATG
TGAAGCTGCTACCTCTGACATGGATATTGGAAAGCGAAAGATAATGTGTGTGGCTGGTATTG
GACTTGTTGTATTATTCTTCAGTTGGATGCTCTCTATTTTTAGATCTAAATATCATGGCTAC
CCATACAGCTTTCTGATGAGTTAAAAAGGTCCCAGAGATATATAGACACTGGAGTACTGGAA
ATTGAAAAACGAAATCGTGTGTGTTTGAAAAGAAGAATGCAACTTGTATATTTGTATTAC
CTCTTTTTTTCAAGTGATTTAAATAGTTAATCATTTAACCAAAGAAGATGTGTAGTGCCTTA
ACAAGCAATCCTCTGTCAAAATCTGAGGTATTTGAAAATAATTATCCTCTTAACCTTCTCTT
CCCAGTGAACTTTATGGAACATTTAATTTAGTACAATTAAGTATATTATAAAAATTGTAAAA
CTACTACTTTGTTTTAGTTAGAACAAAGCTCAAAACTACTTTAGTTAACTTGGTCATCTGAT
TTTATATTGCCTTATCCAAAGATGGGGAAAGTAAGTCCTGACCAGGTGTTCCCACATATGCC
TGTTACAGATAACTACATTAGGAATTCATTCTTAGCTTCTTCATCTTTGTGTGGATGTGTAT
ACTTTACGCATCTTTCCTTTTGAGTAGAGAAATTATGTGTGTCATGTGGTCTTCTGAAAATG
GAACACCATTCTTCAGAGCACACGTCTAGCCCTCAGCAAGACAGTTGTTTCTCCTCCTCCTT
GCATATTTCCTACTGCGCTCCAGCCTGAGTGATAGAGTGAGACTCTGTCTCAAAAAAAGTA
TCTCTAAATACAGGATTATAATTTCTGCTTGAGTATGGTGTTAACTACCTTGTATTTAGAAA
GATTTCAGATTCATTCCATCTCCTTAGTTTTCTTTTAAGGTGACCCATCTGTGATAAAAATA
TAGCTTAGTGCTAAAATCAGTGTAACTTATACATGGCCTAAAATGTTTCTACAAATTAGAGT
TTGTCACTTATTCCATTTGTACCTAAGAGAAAATAGGCTCAGTTAGAAAAGGACTCCCTGG
CCAGGCGCAGTGACTTACGCCTGTAATCTCAGCACTTTGGGAGGCCAAGGCAGGCAGATCAC
GAGGTCAGGAGTTCGAGACCATCCTGGCCAACATGGTGAAACCCCGTCTCTACTAAAAATAT
AAAAATTAGCTGGGTGTGGTGGCAGGAGCCTGTAATCCCAGCTACACAGGAGGCTGAGGCAC
GAGAATCACTTGAACTCAGGAGATGGAGGTTTCAGTGAGCCGAGATCACGCCACTGCACTCC
AGCCTGGCAACAGAGCGAGACTCCATCTCAAAAAAAAAAAAAA
```

FIGURE 74

MAARWRFWCVSVTMVVALLIVCDVPSASAQRKKEMVLSEKVSQLMEWTNKRPVIRMNGDKFR
RLVKAPPRNYSVIVMFTALQLHRQCVVCKQADEEFQILANSWRYSSAFTNRIFFAMVDFDEG
SDVFQMLNMNSAPTFINFPAKGKPKRGDTYELQVRGFSAEQIARWIADRTDVNIRVIRPPNY
AGPLMLGLLLAVIGGLVYLRRSNMEFLFNKTGWAFAALCFVLAMTSGQMWNHIRGPPYAHKN
PHTGHVNYIHGSSQAQFVAETHIVLLFNGGVTLGMVLLCEAATSDMDIGKRKIMCVAGIGLV
VLFFSWMLSIFRSKYHGYPYSFLMS

Signal peptide:

amino acids 1-29

Transmembrane domains:

amino acids 183-205, 217-237, 217-287, 301-321

FIGURE 75

```
AAGCAACCAAACTGCAAGCTTTGGGAGTTGTTCGCTGTCCCTGCCCTGCTCTGCTAGGGAGA
GAACGCCAGAGGGAGGCGGCTGGCCCGGCGGCAGGCTCTCAGAACCGCTACCGGCGATGCTA
CTGCTGTGGGTGTCGGTGGTCGCAGCCTTGGCGCTGGCGGTACTGGCCCCCGGAGCAGGGGA
GCAGAGGCGGAGAGCAGCCAAAGCGCCCAATGTGGTGCTGGTCGTGAGCGACTCCTTCGATG
GAAGGTTAACATTTCATCCAGGAAGTCAGGTAGTGAAACTTCCTTTTATCAACTTTATGAAG
ACACGTGGGACTTCCTTTCTGAATGCCTACACAAACTCTCCAATTTGTTGCCCATCACGCGC
AGCAATGTGGAGTGGCCTCTTCACTCACTTAACAGAATCTTGGAATAATTTTAAGGGTCTAG
ATCCAAATTATACAACATGGATGGATGTCATGGAGAGGCATGGCTACCGAACACAGAAATTT
GGGAAACTGGACTATACTTCAGGACATCACTCCATTAGTAATCGTGTGGAAGCGTGGACAAG
AGATGTTGCTTTCTTACTCAGACAAGAAGGCAGGCCCATGGTTAATCTTATCCGTAACAGGA
CTAAAGTCAGAGTGATGGAAAGGGATTGGCAGAATACAGACAAAGCAGTAAACTGGTTAAGA
AAGGAAGCAATTAATTACACTGAACCATTTGTTATTTACTTGGGATTAAATTTACCACACCC
TTACCCTTCACCATCTTCTGGAGAAAATTTGGATCTTCAACATTTCACACATCTCTTTATT
GGCTTGAAAAAGTGTCTCATGATGCCATCAAAATCCCAAAGTGGTCACCTTTGTCAGAAATG
CACCCTGTAGATTATTACTCTTCTTATACAAAAAACTGCACTGGAAGATTTACAAAAAAAGA
AATTAAGAATATTAGAGCATTTTATTATGCTATGTGTGCTGAGACAGATGCCATGCTTGGTG
AAATTATTTTGGCCCTTCATCAATTAGATCTTCTTCAGAAAACTATTGTCATATACTCCTCA
GACCATGGAGAGCTGGCCATGGAACATCGACAGTTTTATAAAATGAGCATGTACGAGGCTAG
TGCACATGTTCCGCTTTTGATGATGGGACCAGGAATTAAAGCCGGCCTACAAGTATCAAATG
TGGTTTCTCTTGTGGATATTTACCCTACCATGCTTGATATTGCTGGAATTCCTCTGCCTCAG
AACCTGAGTGGATACTCTTTGTTGCCGTTATCATCAGAAACATTTAAGAATGAACATAAAGT
CAAAAACCTGCATCCACCCTGGATTCTGAGTGAATTCCATGGATGTAATGTGAATGCCTCCA
CCTACATGCTTCGAACTAACCACTGGAAATATATAGCCTATTCGGATGGTGCATCAATATTG
CCTCAACTCTTTGATCTTTCCTCGGATCCAGATGAATTAACAAATGTTGCTGTAAAATTTCC
AGAAATTACTTATTCTTTGGATCAGAAGCTTCATTCCATTATAAACTACCCTAAAGTTTCTG
CTTCTGTCCACCAGTATAATAAAGAGCAGTTTATCAAGTGGAAACAAAGTATAGGACAGAAT
TATTCAAACGTTATAGCAAATCTTAGGTGGCACCAAGACTGGCAGAAGGAACCAAGGAAGTA
TGAAAATGCAATTGATCAGTGGCTTAAAACCCATATGAATCCAAGAGCAGTTTGAACAAAAA
GTTTAAAAATAGTGTTCTAGAGATACATATAAATATATTACAAGATCATAATTATGTATTTT
AAATGAAACAGTTTTAATAATTACCAAGTTTTGGCCGGGCACAGTGGCTCACACCTGTAATC
CCAGGACTTTGGGAGGCTGAGGAAAGCAGATCACAAGGTCAAGAGATTGAGACCATCCTGGC
CAACATGGTGAAACCCTGTCTCTACTAAAAATACAAAAATTAGCTGGGCGCGGTGGTGCACA
CCTATAGTCTCAGCTACTCAGAGGCTGAGGCAGGAGGATCGCTTGAACCCGGGAGGCAGCAG
TTGCAGTGAGCTGAGATTGCGCCACTGTACTCCAGCCTGGCAACAGAGTGAGACTGTGTCGC
AAAAAAATAAAAATAAAATAATAATAATTACCAATTTTTCATTATTTTGTAAGAATGTAGTG
TATTTAAGATAAAATGCCAATGATTATAAAATCACATATTTTCAAAAATGGTTATTATTTA
GGCCTTTGTACAATTTCTAACAATTTAGTGGAAGTATCAAAAGGATTGAAGCAAATACTGTA
ACAGTTATGTTCCTTTAAATAATAGAGAATATAAAATATTGTAATAATATGTATCATAAAAT
AGTTGTATGTGAGCATTTGATGGTGAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAA
```

FIGURE 76

</usr/seqdb2/sst/DNA/Dnaseqs.min/ss.DNA64885
<subunit 1 of 1, 536 aa, 1 stop
<MW: 61450, pI: 9.17, NX(S/T): 7

MLLLWVSVVAALALAVLAPGAGEQRRRAAKAPNVVLVVSDSFDGRLTFHPGSQVVKLPFINF
MKTRGTSFLNAYTNSPICCPSRAAMWSGLFTHLTESWNNFKGLDPNYTTWMDVMERHGYRTQ
KFGKLDYTSGHHSISNRVEAWTRDVAFLLRQEGRPMVNLIRNRTKVRVMERDWQNTDKAVNW
LRKEAINYTEPFVIYLGLNLPHPYPSPSSGENFGSSTFHTSLYWLEKVSHDAIKIPKWSPLS
EMHPVDYYSSYTKNCTGRFTKKEIKNIRAFYYAMCAETDAMLGEIILALHQLDLLQKTIVIY
SSDHGELAMEHRQFYKMSMYEASAHVPLLMMGPGIKAGLQVSNVVSLVDIYPTMLDIAGIPL
PQNLSGYSLLPLSSETFKNEHKVKNLHPPWILSEFHGCNVNASTYMLRTNHWKYIAYSDGAS
ILPQLFDLSSDPDELTNVAVKFPEITYSLDQKLHSIINYPKVSASVHQYNKEQFIKWKQSIG
QNYSNVIANLRWHQDWQKEPRKYENAIDQWLKTHMNPRAV

Important features:
Signal peptide:
amino acids 1-15

N-glycosylation sites.
amino acids 108-111, 166-169, 193-196, 262-265, 375-378, 413-416, 498-501

Sulfatases proteins:
amino acids 286-315, 359-369, 78-97

FIGURE 77

GAGAGAAGTCAGCCTGGCAGAGAGACTCTGAAATGAGGGATTAGAGGTGTTCAAGGAGCAAG
AGCTTCAGCCTGAAGACAAGGGAGCAGTCCCTGAAGACGCTTCTACTGAGAGGTCTGCCATG
GCCTCTCTTGGCCTCCAACTTGTGGGCTACATCCTAGGCCTTCTGGGGCTTTTGGGCACACT
GGTTGCCATGCTGCTCCCCAGCTGGAAAACAAGTTCTTATGTCGGTGCCAGCATTGTGACAG
CAGTTGGCTTCTCCAAGGGCCTCTGGATGGAATGTGCCACACACAGCACAGGCATCACCCAG
TGTGACATCTATAGCACCCTTCTGGGCCTGCCCGCTGACATCCAGGCTGCCCAGGCCATGAT
GGTGACATCCAGTGCAATCTCCTCCCTGGCCTGCATTATCTCTGTGGTGGGCATGAGATGCA
CAGTCTTCTGCCAGGAATCCCGAGCCAAAGACAGAGTGGCGGTAGCAGGTGGAGTCTTTTTC
ATCCTTGGAGGCCTCCTGGGATTCATTCCTGTTGCCTGGAATCTTCATGGGATCCTACGGGA
CTTCTACTCACCACTGGTGCCTGACAGCATGAAATTTGAGATTGGAGAGGCTCTTTACTTGG
GCATTATTTCTTCCCTGTTCTCCCTGATAGCTGGAATCATCCTCTGCTTTTCCTGCTCATCC
CAGAGAAATCGCTCCAACTACTACGATGCCTACCAAGCCCAACCTCTTGCCACAAGGAGCTC
TCCAAGGCCTGGTCAACCTCCCAAAGTCAAGAGTGAGTTCAATTCCTACAGCCTGACAGGGT
ATGTGTGAAGAACCAGGGGCCAGAGCTGGGGGGTGGCTGGGTCTGTGAAAAACAGTGGACAG
CACCCCGAGGGCCACAGGTGAGGGACACTACCACTGGATCGTGTCAGAAGGTGCTGCTGAGG
ATAGACTGACTTTGGCCATTGGATTGAGCAAAGGCAGAAATGGGGGCTAGTGTAACAGCATG
CAGGTTGAATTGCCAAGGATGCTCGCCATGCCAGCCTTTCTGTTTTCCTCACCTTGCTGCTC
CCCTGCCCTAAGTCCCCAACCCTCAACTTGAAACCCCATTCCCTTAAGCCAGGACTCAGAGG
ATCCCTTTGCCCTCTGGTTTACCTGGGACTCCATCCCCAAACCCACTAATCACATCCCACTG
ACTGACCCTCTGTGATCAAAGACCCTCTCTCTGGCTGAGGTTGGCTCTTAGCTCATTGCTGG
GGATGGGAAGGAGAAGCAGTGGCTTTTGTGGGCATTGCTCTAACCTACTTCTCAAGCTTCCC
TCCAAAGAAACTGATTGGCCCTGGAACCTCCATCCCACTCTTGTTATGACTCCACAGTGTCC
AGACTAATTTGTGCATGAACTGAAATAAAACCATCCTACGGTATCCAGGGAACAGAAAGCAG
GATGCAGGATGGGAGGACAGGAAGGCAGCCTGGGACATTTAAAAAAATA

FIGURE 78

></usr/seqdb2/sst/DNA/Dnaseqs.min/ss.DNA64886
><subunit 1 of 1, 230 aa, 1 stop
><MW: 24549, pI: 8.56, NX(S/T): 1
MASLGLQLVGYILGLLGLLGTLVAMLLPSWKTSSYVGASIVTAVGFSKGLWMECATHSTGIT
QCDIYSTLLGLPADIQAAQAMMVTSSAISSLACIISVVGMRCTVFCQESRAKDRVAVAGGVF
FILGGLLGFIPVAWNLHGILRDFYSPLVPDSMKFEIGEALYLGIISSLFSLIAGIILCFSCS
SQRNRSNYYDAYQAQPLATRSSPRPGQPPKVKSEFNSYSLTGYV

Important features of the protein:

Signal peptide:
amino acids 1-24

Transmembrane domains:
amino acids 82-102, 117-140, 163-182

N-glycosylation site.
amino acids 190-193

PMP-22 / EMP / MP20 family proteins.
amino acids 46-59

FIGURE 79

GCACTGCTGCTGTCCCATCAGCTGCTCTGAAGCTCCATGGTGCCCAGAATCTTCGCTCCTGC
TTATGTGTCAGTCTGTCTCCTCCTCTTGTGTCCAAGGGAAGTCATCGCTCCCGCTGGCTCAG
AACCATGGCTGTGCCAGCCGGCACCCAGGTGTGGAGACAAGATCTACAACCCCTTGGAGCAG
TGCTGTTACAATGACGCCATCGTGTCCCTGAGCGAGACCCGCCAATGTGGTCCCCCCTGCAC
CTTCTGGCCCTGCTTTGAGCTCTGCTGTCTTGATTCCTTTGGCCTCACAAACGATTTTGTTG
TGAAGCTGAAGGTTCAGGGTGTGAATTCCCAGTGCCACTCATCTCCCATCTCCAGTAAATGT
GAAAGCAGAAGACGTTTTCCCTGAGAAGACATAGAAAGAAAATCAACTTTCACTAAGGCATC
TCAGAAACATAGGCTAAGGTAATATGTGTACCAGTAGAGAAGCCTGAGGAATTTACAAAATG
ATGCAGCTCCAAGCCATTGTATGGCCCATGTGGGAGACTGATGGACATGGAGAATGACAGT
AGATTATCAGGAAATAAATAAAGTGGTTTTTCCAATGTACACACCTGTAAAA

FIGURE 80

MVPRIFAPAYVSVCLLLLCPREVIAPAGSEPWLCQPAPRCGDKIYNPLEQCCYNDAIVSLSE
TRQCGPPCTFWPCFELCCLDSFGLTNDFVVKLKVQGVNSQCHSSPISSKCESRRRFP

Signal peptide:

amino acids 1-25

FIGURE 81

CTCCACTGCAACCACCCAGAGCCATGGCTCCCCGAGGCTGCATCGTAGCTGTCTTTGCCATT
TTCTGCATCTCCAGGCTCCTCTGCTCACACGGAGCCCCAGTGGCCCCATGACTCCTTACCT
GATGCTGTGCCAGCCACACAAGAGATGTGGGGACAAGTTCTACGACCCCCTGCAGCACTGTT
GCTATGATGATGCCGTCGTGCCCTTGGCCAGGACCCAGACGTGTGGAAACTGCACCTTCAGA
GTCTGCTTTGAGCAGTGCTGCCCCTGGACCTTCATGGTGAAGCTGATAAACCAGAACTGCGA
CTCAGCCCGGACCTCGGATGACAGGCTTTGTCGCAGTGTCAGCTAATGGAACATCAGGGGAA
CGATGACTCCTGGATTCTCCTTCCTGGGTGGGCCTGGAGAAAGAGGCTGGTGTTACCTGAGA
TCTGGGATGCTGAGTGGCTGTTTGGGGGCCAGAGAAACACACACTCAACTGCCCACTTCATT
CTGTGACCTGTCTGAGGCCCACCCTGCAGCTGCCCTGAGGAGGCCCACAGGTCCCCTTCTAG
AATTCTGGACAGCATGAGATGCGTGTGCTGATGGGGCCCAGGGACTCTGAACCCTCCTGAT
GACCCCTATGGCCAACATCAACCCGGCACCACCCCAAGGCTGGCTGGGGAACCCTTCACCCT
TCTGTGAGATTTTCCATCATCTCAAGTTCTCTTCTATCCAGGAGCAAAGCACAGGATCATAA
TAAATTTATGTACTTTATAAATGAAAA

FIGURE 82

MAPRGCIVAVFAIFCISRLLCSHGAPVAPMTPYLMLCQPHKRCGDKFYDPLQHCCYDDAVVP
LARTQTCGNCTFRVCFEQCCPWTFMVKLINQNCDSARTSDDRLCRSVS

Signal peptide:
amino acids 1-24

FIGURE 83

GGGGGCGGGTGCCTGGAGCACGGCGCTGGGGCCGCCCGCAGCGCTCACTCGCTCGCACTCAG
TCGCGGGAGGCTTCCCCGCGCCGGCCGCGTCCCGCCCGCTCCCCGGCACCAGAAGTTCCTCT
GCGCGTCCGACGGCGACATGGGCGTCCCCACGGCCCTGGAGGCCGGCAGCTGGCGCTGGGGA
TCCCTGCTCTTCGCTCTCTTCCTGGCTGCGTCCCTAGGTCCGGTGGCAGCCTTCAAGGTCGC
CACGCCGTATTCCCTGTATGTCTGTCCCGAGGGGCAGAACGTCACCCTCACCTGCAGGCTCT
TGGGCCCTGTGGACAAAGGGCACGATGTGACCTTCTACAAGACGTGGTACCGCAGCTCGAGG
GGCGAGGTGCAGACCTGCTCAGAGCGCCGGCCCATCCGCAACCTCACGTTCCAGGACCTTCA
CCTGCACCATGGAGGCCACCAGGCTGCCAACACCAGCCACGACCTGGCTCAGCGCCACGGGC
TGGAGTCGGCCTCCGACCACCATGGCAACTTCTCCATCACCATGCGCAACCTGACCCTGCTG
GATAGCGGCCTCTACTGCTGCCTGGTGGTGGAGATCAGGCACCACCACTCGGAGCACAGGGT
CCATGGTGCCATGGAGCTGCAGGTGCAGACAGGCAAAGATGCACCATCCAACTGTGTGGTGT
ACCCATCCTCCTCCCAGGATAGTGAAAACATCACGGCTGCAGCCCTGGCTACGGGTGCCTGC
ATCGTAGGAATCCTCTGCCTCCCCCTCATCCTGCTCCTGGTCTACAAGCAAAGGCAGGCAGC
CTCCAACCGCCGTGCCCAGGAGCTGGTGCGGATGGACAGCAACATTCAAGGGATTGAAAACC
CCGGCTTTGAAGCCTCACCACCTGCCCAGGGGATACCCGAGGCCAAAGTCAGGCACCCCTG
TCCTATGTGGCCCAGCGGCAGCCTTCTGAGTCTGGGCGGCATCTGCTTTCGGAGCCCAGCAC
CCCCCTGTCTCCTCCAGGCCCCGGAGACGTCTTCTTCCCATCCCTGGACCCTGTCCCTGACT
CTCCAAACTTTGAGGTCATCTAGCCCAGCTGGGGACAGTGGGCTGTTGTGGCTGGGTCTGG
GGCAGGTGCATTTGAGCCAGGGCTGGCTCTGTGAGTGGCCTCCTTGGCCTCGGCCCTGGTTC
CCTCCCTCCTGCTCTGGGCTCAGATACTGTGACATCCCAGAAGCCCAGCCCCTCAACCCCTC
TGGATGCTACATGGGGATGCTGGACGGCTCAGCCCCTGTTCCAAGGATTTTGGGGTGCTGAG
ATTCTCCCCTAGAGACCTGAAATTCACCAGCTACAGATGCCAAATGACTTACATCTTAAGAA
GTCTCAGAACGTCCAGCCCTTCAGCAGCTCTCGTTCTGAGACATGAGCCTTGGGATGTGGCA
GCATCAGTGGGACAAGATGGACACTGGGCCACCCTCCCAGGCACCAGACACAGGGCACGGTG
GAGAGACTTCTCCCCCGTGGCCGCCTTGGCTCCCCGTTTTGCCCGAGGCTGCTCTTCTGTC
AGACTTCCTCTTTGTACCACAGTGGCTCTGGGGCCAGGCCTGCCTGCCCACTGGCCATCGCC
ACCTTCCCCAGCTGCCTCCTACCAGCAGTTTCTCTGAAGATCTGTCAACAGGTTAAGTCAAT
CTGGGGCTTCCACTGCCTGCATTCCAGTCCCCAGAGCTTGGTGGTCCCGAAACGGGAAGTAC
ATATTGGGGCATGGTGGCCTCCGTGAGCAAATGGTGTCTTGGGCAATCTGAGGCCAGGACAG
ATGTTGCCCCACCCACTGGAGATGGTGCTGAGGGAGGTGGGTGGGCCTTCTGGGAAGGTGA
GTGGAGAGGGGCACCTGCCCCCGCCCTCCCCATCCCCTACTCCCACTGCTCAGCGCGGGCC
ATTGCAAGGGTGCCACACAATGTCTTGTCCACCCTGGGACACTTCTGAGTATGAAGCGGGAT
GCTATTAAAAACTACATGGGGAAAAAAAAAAAAAAAAAAAAAAAAAAAAAAAAAAAAAAAGA

FIGURE 84

```
></usr/seqdb2/sst/DNA/Dnaseqs.min/ss.DNA64897
><subunit 1 of 1, 311 aa, 1 stop
><MW: 33908, pI: 6.87, NX(S/T): 6
MGVPTALEAGSWRWGSLLFALFLAASLGPVAAFKVATPYSLYVCPEGQNVTLTCRLLGPVDK
GHDVTFYKTWYRSSRGEVQTCSERRPIRNLTFQDLHLHHGGHQAANTSHDLAQRHGLESASD
HHGNFSITMRNLTLLDSGLYCCLVVEIRHHHSEHRVHGAMELQVQTGKDAPSNCVVYPSSSQ
DSENITAAALATGACIVGILCLPLILLLVYKQRQAASNRRAQELVRMDSNIQGIENPGFEAS
PPAQGIPEAKVRHPLSYVAQRQPSESGRHLLSEPSTPLSPPGPGDVFFPSLDPVPDSPNFEVI
```

Signal peptide:

amino acids 1-28

Transmembrane domain:

amino acids 190-216

FIGURE 85

CCCACGCGTCCGCGCCTCTCCCTTCTGCTGGACCTTCCTTCGTCTCTCCATCTCTCCCTCCT
TTCCCCGCGTTCTCTTTCCACCTTTCTCTTCTTCCCACCTTAGACCTCCCTTCCTGCCCTCC
TTTCCTGCCCACCGCTGCTTCCTGGCCCTTCTCCGACCCCGCTCTAGCAGCAGACCTCCTGG
GGTCTGTGGGTTGATCTGTGGCCCCTGTGCCTCCGTGTCCTTTTCGTCTCCCTTCCTCCCGA
CTCCGCTCCCGGACCAGCGGCCTGACCCTGGGGAAAGATGGTTCCCGAGGTGAGGTCCTC
TCCTCCTTGCTGGGACTCGCGCTGCTCTGGTTCCCCCTGGACTCCCACGCTCGAGCCCGCCC
AGACATGTTCTGCCTTTTCCATGGGAAGAGATACTCCCCCGGCGAGAGCTGGCACCCCTACT
TGGAGCCACAAGGCCTGATGTACTGCCTGCGCTGTACCTGCTCAGAGGGCGCCCATGTGAGT
TGTTACCGCCTCCACTGTCCGCCTGTCCACTGCCCCAGCCTGTGACGGAGCCACAGCAATG
CTGTCCCAAGTGTGTGGAACCTCACACTCCCTCTGGACTCCGGGCCCCACCAAAGTCCTGCC
AGCACAACGGGACCATGTACCAACACGGAGAGATCTTCAGTGCCCATGAGCTGTTCCCCTCC
CGCCTGCCCAACCAGTGTGTCCTCTGCAGCTGCACAGAGGGCCAGATCTACTGCGGCCTCAC
AACCTGCCCCGAACCAGGCTGCCCAGCACCCTCCCACTGCCAGACTCCTGCTGCCAAGCCT
GCAAAGATGAGGCAAGTGAGCAATCGGATGAAGAGGACAGTGTGCAGTCGCTCCATGGGGTG
AGACATCCTCAGGATCCATGTTCCAGTGATGCTGGGAGAAAGAGAGGCCCGGGCACCCCAGC
CCCCACTGGCCTCAGCGCCCCTCTGAGCTTCATCCCTCGCCACTTCAGACCCAAGGGAGCAG
GCAGCACAACTGTCAAGATCGTCCTGAAGGAGAAACATAAGAAAGCCTGTGTGCATGGCGGG
AAGACGTACTCCCACGGGGAGGTGTGGCACCCGGCCTTCCGTGCCTTCGGCCCCTTGCCCTG
CATCCTATGCACCTGTGAGGATGGCCGCCAGGACTGCCAGCGTGTGACCTGTCCACCGAGT
ACCCCTGCCGTCACCCCGAGAAAGTGGCTGGGAAGTGCTGCAAGATTTGCCCAGAGGACAAA
GCAGACCCTGGCCACAGTGAGATCAGTTCTACCAGGTGTCCCAAGGCACCGGGCCGGGTCCT
CGTCCACACATCGGTATCCCCAAGCCCAGACAACCTGCGTCGCTTTGCCCTGGAACACGAGG
CCTCGGACTTGGTGGAGATCTACCTCTGGAAGCTGGTAAAGATGAGGAAACTGAGGCTCAG
AGAGGTGAAGTACCTGGCCCAAGGCCACACAGCCAGAATCTTCCACTTGACTCAGATCAAGA
AAGTCAGGAAGCAAGACTTCCAGAAAGAGGCACAGCACTTCCGACTGCTCGCTGGCCCCAC
GAAGGTCACTGGAACGTCTTCCTAGCCCAGACCCTGGAGCTGAAGGTCACGGCCAGTCCAGA
CAAAGTGACCAAGACATAACAAAGACCTAACAGTTGCAGATATGAGCTGTATAATTGTTGTT
ATTATATATTAATAAATAAGAAGTTGCATTACCCTCAAAAAAAAAAAAAAAAAAAAAA

FIGURE 86

></usr/seqdb2/sst/DNA/Dnaseqs.min/ss.DNA64902
><subunit 1 of 1, 451 aa, 1 stop
><MW: 49675, pI: 7.15, NX(S/T): 1
MVPEVRVLSSLLGLALLWFPLDSHARARPDMFCLFHGKRYSPGESWHPYLEPQGLMYCLRCT
CSEGAHVSCYRLHCPPVHCPQPVTEPQQCCPKCVEPHTPSGLRAPPKSCQHNGTMYQHGEIF
SAHELFPSRLPNQCVLCSCTEGQIYCGLTTCPEPGCPAPLPLPDSCCQACKDEASEQSDEED
SVQSLHGVRHPQDPCSSDAGRKRGPGTPAPTGLSAPLSFIPRHFRPKGAGSTTVKIVLKEKH
KKACVHGGKTYSHGEVWHPAFRAFGPLPCILCTCEDGRQDCQRVTCPTEYPCRHPEKVAGKC
CKICPEDKADPGHSEISSTRCPKAPGRVLVHTSVSPSPDNLRRFALEHEASDLVEIYLWKLV
KDEETEAQRGEVPGPRPHSQNLPLDSDQESQEARLPERGTALPTARWPPRRSLERLPSPDPG
AEGHGQSRQSDQDITKT

Signal peptide:
amino acids 1-25

FIGURE 87

```
CTAGCCTGCGCCAAGGGGTAGTGAGACCGCGCGGCAACAGCTTGCGGCTGCGGGGAGCTCCC
GTGGGCGCTCCGCTGGCTGTGCAGGCGGCCATGGATTCCTTGCGGAAAATGCTGATCTCAGT
CGCAATGCTGGGCGCAGGGGCTGGCGTGGGCTACGCGCTCCTCGTTATCGTGACCCCGGGAG
AGCGGCGGAAGCAGGAAATGCTAAAGGAGATGCCACTGCAGGACCCAAGGAGCAGGGAGGAG
GCGGCCAGGACCCAGCAGCTATTGCTGGCCACTCTGCAGGAGGCAGCGACCACGCAGGAGAA
CGTGGCCTGGAGGAAGAACTGGATGGTTGGCGGCGAAGGCGGCGCCAGCGGGAGGTCACCGT
GAGACCGGACTTGCCTCCGTGGGCGCCGGACCTTGGCTTGGGCGCAGGAATCCGAGGCAGCC
TTTCTCCTTCGTGGGCCCAGCGGAGAGTCCGGACCGAGATACCATGCCAGGACTCTCCGGGG
TCCTGTGAGCTGCCGTCGGGTGAGCACGTTTCCCCCAAACCCTGGACTGACTGCTTTAAGGT
CCGCAAGGCGGGCCAGGGCCGAGACGCGAGTCGGATGTGGTGAACTGAAAGAACCAATAAAA
TCATGTTCCTCCAAAAAAAAAAAAAAAAAAAAAAAAAAAAAAAAAAAAAAAAAAAAAAAAAA
AAAAAAAAAA
```

FIGURE 88

MDSLRKMLISVAMLGAGAGVGYALLVIVTPGERRKQEMLKEMPLQDPRSREEAARTQQLLLA
TLQEAATTQENVAWRKNWMVGGEGGASGRSP

Signal peptide:
amino acids 1-18

FIGURE 89

CAGGAGAGAAGGCACCGCCCCCACCCCGCCTCCAAAGCTAACCCTCGGGCTTGAGGGGAAGA
GGCTGACTGTACGTTCCTTCTACTCTGGCACCACTCTCCAGGCTGCCATGGGGCCCAGCACC
CCTCTCCTCATCTTGTTCCTTTTGTCATGGTCGGGACCCCTCCAAGGACAGCAGCACCACCT
TGTGGAGTACATGGAACGCCGACTAGCTGCTTTAGAGGAACGGCTGGCCCAGTGCCAGGACC
AGAGTAGTCGGCATGCTGCTGAGCTGCGGGACTTCAAGAACAAGATGCTGCCACTGCTGGAG
GTGGCAGAGAAGGAGCGGGAGGCACTCAGAACTGAGGCCGACACCATCTCCGGGAGAGTGGA
TCGTCTGGAGCGGGAGGTAGACTATCTGGAGACCCAGAACCCAGCTCTGCCCTGTGTAGAGT
TTGATGAGAAGGTGACTGGAGGCCCTGGGACCAAAGGCAAGGGAAGAAGGAATGAGAAGTAC
GATATGGTGACAGACTGTGGCTACACAATCTCTCAAGTGAGATCAATGAAGATTCTGAAGCG
ATTTGGTGGCCCAGCTGGTCTATGGACCAAGGATCCACTGGGGCAAACAGAGAAGATCTACG
TGTTAGATGGGACACAGAATGACACAGCCTTTGTCTTCCCAAGGCTGCGTGACTTCACCCTT
GCCATGGCTGCCCGGAAAGCTTCCCGAGTCCGGGTGCCCTTCCCTGGGTAGGCACAGGGCA
GCTGGTATATGGTGGCTTTCTTTATTTTGCTCGGAGGCCTCCTGGAAGACCTGGTGGAGGTG
GTGAGATGGAGAACACTTTGCAGCTAATCAAATTCCACCTGGCAAACCGAACAGTGGTGGAC
AGCTCAGTATTCCCAGCAGAGGGGCTGATCCCCCCTACGGCTTGACAGCAGACACCTACAT
CGACCTGGTAGCTGATGAGGAAGGTCTTTGGGCTGTCTATGCCACCCGGGAGGATGACAGGC
ACTTGTGTCTGGCCAAGTTAGATCCACAGACACTGGACACAGAGCAGCAGTGGGACACACCA
TGTCCCAGAGAGAATGCTGAGGCTGCCTTTGTCATCTGTGGGACCCTCTATGTCGTCTATAA
CACCCGTCCTGCCAGTCGGGCCCGCATCCAGTGCTCCTTTGATGCCAGCGGCACCCTGACCC
CTGAACGGGCAGCACTCCCTTATTTTCCCCGCAGATATGGTGCCCATGCCAGCCTCCGCTAT
AACCCCCGAGAACGCCAGCTCTATGCCTGGGATGATGGCTACCAGATTGTCTATAAGCTGGA
GATGAGGAAGAAAGAGGAGGAGGTTTGAGGAGCTAGCCTTGTTTTTGCATCTTTCTCACTC
CCATACATTTATATTATATCCCCACTAAATTTCTTGTTCCTCATTCTTCAAATGTGGGCCAG
TTGTGGCTCAAATCCTCTATATTTTTAGCCAATGGCAATCAAATTCTTTCAGCTCCTTTGTT
TCATACGGAACTCCAGATCCTGAGTAATCCTTTTAGAGCCCGAAGAGTCAAAACCCTCAATG
TTCCCTCCTGCTCTCCTGCCCCATGTCAACAAATTTCAGGCTAAGGATGCCCCAGACCCAGG
GCTCTAACCTTGTATGCGGGCAGGCCCAGGGAGCAGGCAGCAGTGTTCTTCCCCTCAGAGTG
ACTTGGGGAGGGAGAAATAGGAGGAGACGTCCAGCTCTGTCCTCTCTTCCTCACTCCTCCCT
TCAGTGTCCTGAGGAACAGGACTTTCTCCACATTGTTTTGTATTGCAACATTTTGCATTAAA
AGGAAAATCCACAAAAAAAAAAAAAAAAAAAAAAAAAAAAAAAAAAAAAAAAAAAAAAAAAA
AAAAAAAAAAAAAAAAAAAAA

FIGURE 90

```
</usr/seqdb2/sst/DNA/Dnaseqs.min/ss.DNA64905
<subunit 1 of 1, 406 aa, 1 stop
<MW: 46038, pI: 6.50, NX(S/T): 2
MGPSTPLLILFLLSWSGPLQGQQHHLVEYMERRLAALEERLAQCQDQSSRHAAELRDFKNKM
LPLLEVAEKEREALRTEADTISGRVDRLEREVDYLETQNPALPCVEFDEKVTGGPGTKGKGR
RNEKYDMVTDCGYTISQVRSMKILKRFGGPAGLWTKDPLGQTEKIYVLDGTQNDTAFVFPRL
RDFTLAMAARKASRVRVPFPWVGTGQLVYGGFLYFARRPPGRPGGGEMENTLQLIKFHLAN
RTVVDSSVFPAEGLIPPYGLTADTYIDLVADEEGLWAVYATREDDRHLCLAKLDPQTLDTEQ
QWDTPCPRENAEAAFVICGTLYVVYNTRPASRARIQCSFDASGTLTPERAALPYFPRRYGAH
ASLRYNPRERQLYAWDDGYQIVYKLEMRKKEEEV
```

Important features:

Signal peptide:

amino acids 1-21

N-glycosylation sites.

amino acids 177-180, 248-251

FIGURE 91

GACAGCTGTGTCTCGATGGAGTAGACTCTCAGAACAGCGCAGTTTGCCCTCCGCTCACGCAG
AGCCTCTCCGTGGCTTCCGCACCTTGAGCATTAGGCCAGTTCTCCTCTTCTCTCTAATCCAT
CCGTCACCTCTCCTGTCATCCGTTTCCATGCCGTGAGGTCCATTCACAGAACACATCCATGG
CTCTCATGCTCAGTTTGGTTCTGAGTCTCCTCAAGCTGGGATCAGGGCAGTGGCAGGTGTTT
GGGCCAGACAAGCCTGTCCAGGCCTTGGTGGGGGAGGACGCAGCATTCTCCTGTTTCCTGTC
TCCTAAGACCAATGCAGAGGCCATGGAAGTGCGGTTCTTCAGGGGCCAGTTCTCTAGCGTGG
TCCACCTCTACAGGGACGGGAAGGACCAGCCATTTATGCAGATGCCACAGTATCAAGGCAGG
ACAAAACTGGTGAAGGATTCTATTGCGGAGGGGCGCATCTCTCTGAGGCTGGAAAACATTAC
TGTGTTGGATGCTGGCCTCTATGGGTGCAGGATTAGTTCCCAGTCTTACTACCAGAAGGCCA
TCTGGGAGCTACAGGTGTCAGCACTGGGCTCAGTTCCTCTCATTTCCATCACGGGATATGTT
GATAGAGACATCCAGCTACTCTGTCAGTCCTCGGGCTGGTTCCCCGGCCCACAGCGAAGTG
GAAAGGTCCACAAGGACAGGATTTGTCCACAGACTCCAGGACAAACAGAGACATGCATGGCC
TGTTTGATGTGGAGATCTCTCTGACCGTCCAAGAGAACGCCGGGAGCATATCCTGTTCCATG
CGGCATGCTCATCTGAGCCGAGAGGTGGAATCCAGGGTACAGATAGGAGATACCTTTTTCGA
GCCTATATCGTGGCACCTGGCTACCAAAGTACTGGGAATACTCTGCTGTGGCCTATTTTTTG
GCATTGTTGGACTGAAGATTTTCTTCTCCAAATTCCAGTGGAAAATCCAGGCGGAACTGGAC
TGGAGAAGAAAGCACGGACAGGCAGAATTGAGAGACGCCCGGAAACACGCAGTGGAGGTGAC
TCTGGATCCAGAGACGGCTCACCCGAAGCTCTGCGTTTCTGATCTGAAAACTGTAACCCATA
GAAAAGCTCCCCAGGAGGTGCCTCACTCTGAGAAGAGATTTACAAGGAAGAGTGTGGTGGCT
TCTCAGAGTTTCCAAGCAGGGAAACATTACTGGGAGGTGGACGGAGGACACAATAAAAGGTG
GCGCGTGGGAGTGTGCCGGGATGATGTGGACAGGAGGAAGGAGTACGTGACTTTGTCTCCCG
ATCATGGGTACTGGGTCCTCAGACTGAATGGAGAACATTTGTATTTCACATTAAATCCCCGT
TTTATCAGCGTCTTCCCCAGGACCCCACCTACAAAAATAGGGGTCTTCCTGGACTATGAGTG
TGGGACCATCTCCTTCTTCAACATAAATGACCAGTCCCTTATTTATACCCTGACATGTCGGT
TTGAAGGCTTATTGAGGCCCTACATTGAGTATCCGTCCTATAATGAGCAAAATGGAACTCCC
ATAGTCATCTGCCCAGTCACCCAGGAATCAGAGAAAGAGGCCTCTTGGCAAAGGGCCTCTGC
AATCCCAGAGACAAGCAACAGTGAGTCCTCCTCACAGGCAACCACGCCCTTCCTCCCCAGGG
GTGAAATGTAGGATGAATCACATCCCACATTCTTCTTTAGGGATATTAAGGTCTCTCTCCCA
GATCCAAAGTCCCGCAGCAGCCGGCCAAGGTGGCTTCCAGATGAAGGGGGACTGGCCTGTCC
ACATGGGAGTCAGGTGTCATGGCTGCCCTGAGCTGGGAGGGAAGAAGGCTGACATTACATTT
AGTTTGCTCTCACTCCATCTGGCTAAGTGATCTTGAAATACCACCTCTCAGGTGAAGAACCG
TCAGGAATTCCCATCTCACAGGCTGTGGTGTAGATTAAGTAGACAAGGAATGTGAATAATGC
TTAGATCTTATTGATGACAGAGTGTATCCTAATGGTTTGTTCATTATATTACACTTTCAGTA
AAAAAA

FIGURE 92

MALMLSLVLSLLKLGSGQWQVFGPDKPVQALVGEDAAFSCFLSPKTNAEAMEVRFFRGQFSS
VVHLYRDGKDQPFMQMPQYQGRTKLVKDSIAEGRISLRLENITVLDAGLYGCRISSQSYYQK
AIWELQVSALGSVPLISITGYVDRDIQLLCQSSGWFPRPTAKWKGPQGQDLSTDSRTNRDMH
GLFDVEISLTVQENAGSISCSMRHAHLSREVESRVQIGDTFFEPISWHLATKVLGILCCGLF
FGIVGLKIFFSKFQWKIQAELDWRRKHGQAELRDARKHAVEVTLDPETAHPKLCVSDLKTVT
HRKAPQEVPHSEKRFTRKSVVASQSFQAGKHYWEVDGGHNKRWRVGVCRDDVDRRKEYVTLS
PDHGYWVLRLNGEHLYFTLNPRFISVFPRTPPTKIGVFLDYECGTISFFNINDQSLIYTLTC
RFEGLLRPYIEYPSYNEQNGTPIVICPVTQESEKEASWQRASAIPETSNSESSSQATTPFLP
RGEM

Signal peptide:

amino acids 1-17

Transmembrane domain:

amino acids 239-255

FIGURE 93

```
GCGATGGTGCGCCCGGTGGCGGTGGCGGCGGCGGTTGCGGAGGCTTCCTTGGTCGGATTGCA
ACGAGGAGAAGATGACTGACCAACCGACTGGCTGAATGAATGAATGGCGGAGCCGAGCGCGC
CATGAGGAGCCTGCCGAGCCTGGGCGGCCTCGCCCTGTTGTGCTGCGCCGCCGCCGCCGCCG
CCGTCGCCTCAGCCGCCTCGGCGGGAATGTCACCGGTGGCGGCGGGGCCGCGGGGCAGGTG
GACGCGTCGCCGGGCCCCGGGTTGCGGGGCGAGCCCAGCCACCCCTTCCCTAGGGCGACGGC
TCCCACGGCCCAGGCCCCGAGGACCGGGCCCCGCGCGCCACCGTCCACCGACCCCTGGCTG
CGACTTCTCCAGCCCAGTCCCCGGAGACCACCCCTCTTTGGGCGACTGCTGGACCCTCTTCC
ACCACCTTTCAGGCGCCGCTCGGCCCCTCGCCGACCACCCCTCCGGCGGCGGAACGCACTTC
GACCACCTCTCAGGCGCCGACCAGACCCGCGCCGACCACCCTTTCGACGACCACTGGCCCGG
CGCCGACCACCCCTGTAGCGACCACCGTACCGGCGCCCACGACTCCCCGGACCCCGACCCCC
GATCTCCCCAGCAGCAGCAACAGCAGCGTCCTCCCCACCCCACCTGCCACCGAGGCCCCCTC
TTCGCCTCCTCCAGAGTATGTATGTAACTGCTCTGTGGTTGGAAGCCTGAATGTGAATCGCT
GCAACCAGACCACAGGGCAGTGTGAGTGTCGGCCAGGTTATCAGGGGCTTCACTGTGAAACC
TGCAAAGAGGGCTTTTACCTAAATTACACTTCTGGGCTCTGTCAGCCATGTGACTGTAGTCC
ACATGGAGCTCTCAGCATACCGTGCAACAGGTAAGCAACAGAGGGTGGAACTGAAGTTTATT
TTATTTTAGCAAGGGAAAAAAAAGGCTGCTACTCTCAAGGACCATACTGGTTTAAACAAAG
GAGGATGAGGGTCATAGATTTACAAAATATTTTATATACTTTTATTCTCTTACTTTATATGT
TATATTTAATGTCAGGATTTAAAAACATCTAATTTACTGATTTAGTTCTTCAAAAGCACTAG
AGTCGCCAATTTTTCTCTGGGATAATTTCTGTAAATTTCATGGGAAAAAATTATTGAAGAAT
AAATCTGCTTTCTGGAAGGGCTTTCAGGCATGAAACCTGCTAGGAGGTTTAGAAATGTTCTT
ATGTTTATTAATATACCATTGGAGTTTGAGGAAATTTGTTGTTTGGTTTATTTTTCTCTCTA
ATCAAAATTCTACATTTGTTTCTTTGGACATCTAAAGCTTAACCTGGGGGTACCCTAATTTA
TTTAACTAGTGGTAAGTAGACTGGTTTTACTCTATTTACCAGTACATTTTTGAGACCAAAAG
TAGATTAAGCAGGAATTATCTTTAAACTATTATGTTATTTGGAGGTAATTTAATCTAGTGGA
ATAATGTACTGTTATCTAAGCATTTGCCTTGTACTGCACTGAAAGTAATTATTCTTTGACCT
TATGTGAGGCACTTGGCTTTTTGTGGACCCCAAGTCAAAAAACTGAAGAGACAGTATTAAAT
AATGAAAAAATAATGACAGGTTATACTCAGTGTAACCTGGGTATAACCCAAGATCTGCTGC
CACTTACGAGCTGTGTTCCTTGGGCAAGTAATTTCCTTTCACTGAGCTTGTTTCTTCTCAAG
GTTGTTGTGAAGATTAAATGAGTTGATATATATAAAATGCCTAGCACATGTCACTCAATAAA
TTCTGGTTTGTTTAATTTCAAAGGAATATTATGGACTGAAATGAGAGAACATGTTTTAAGA
ACTTTTAGCTCCTTGACAAAGAAGTGCTTTATACTTTAGCACTAAATATTTTAAATGCTTTA
TAAATGATATTATACTGTTATGGAATATTGTATCATATTGTAGTTTATTAAAAATGTAGAAG
AGGCTGGGCGCGGTGGCTCACGCCTGTAATCCTAGCACTTTGGGAGGCCAAGGCGGGTGGAT
CACTTGAGGCCAGGAGTTCTAGATGAGCCTGGCCAGCACAGTGAAACCCCGTCTCTACTAAA
AATACAAACAAATTAGCTGGGCGTGGTGGCACACACCTGTAGTCCCAGCTACTCGGGAGGCT
GAGGCAGGAGAATCGGTTGAACCCGGGAGGTGGAGGTTGCAGTGAGCTGAGATCGCGCCACT
GCACTCCAGCCTGGTGAGAGAGGGAGACTCTGTCTTAAAAAAAAAAAAAAAAAAAAAAAAAA
```

FIGURE 94

```
></usr/seqdb2/sst/DNA/Dnaseqs.min/ss.DNA64952
><subunit 1 of 1, 258 aa, 1 stop
><MW: 25716, pI: 8.13, NX(S/T): 5
MRSLPSLGGLALLCCAAAAAAVASAASAGNVTGGGGAAGQVDASPGPGLRGEPSHPFPRATA
PTAQAPRTGPPRATVHRPLAATSPAQSPETTPLWATAGPSSTTFQAPLGPSPTTPPAAERTS
TTSQAPTRPAPTTLSTTTGPAPTTPVATTVPAPTTPRTPTPDLPSSSNSSVLPTPPATEAPS
SPPPEYVCNCSVVGSLNVNRCNQTTGQCECRPGYQGLHCETCKEGFYLNYTSGLCQPCDCSP
HGALSIPCNR
```

Important features of the protein:

Signal peptide:

amino acids 1-25

N-glycosylation sites.

amino acids 30-33, 172-175, 195-198, 208-211, 235-238

EGF-like domain cysteine pattern signature.

amino acids 214-226.

FIGURE 95

TGCGGCGCAGTGTAGACCTGGGAGGATGGGCGGCCTGCTGCTGGCTGCTTTTCTGGCTTTGG
TCTCGGTGCCCAGGGCCCAGGCCGTGTGGTTGGGAAGACTGGACCCTGAGCAGCTTCTTGGG
CCCTGGTACGTGCTTGCGGTGGCCTCCCGGGAAAAGGGCTTTGCCATGGAGAAGGACATGAA
GAACGTCGTGGGGGTGGTGGTGACCCTCACTCCAGAAAACAACCTGCGGACGCTGTCCTCTC
AGCACGGGCTGGGAGGGTGTGACCAGAGTGTCATGGACCTGATAAAGCGAAACTCCGGATGG
GTGTTTGAGAATCCCTCAATAGGCGTGCTGGAGCTCTGGGTGCTGGCCACCAACTTCAGAGA
CTATGCCATCATCTTCACTCAGCTGGAGTTCGGGGACGAGCCCTTCAACACCGTGGAGCTGT
ACAGTCTGACGGAGACAGCCAGCCAGGAGGCCATGGGGCTCTTCACCAAGTGGAGCAGGAGC
CTGGGCTTCCTGTCACAGTAGCAGGCCCAGCTGCAGAAGGACCTCACCTGTGCTCACAAGAT
CCTTCTGTGAGTGCTGCGTCCCCAGTAGGGATGGCGCCCACAGGGTCCTGTGACCTCGGCCA
GTGTCCACCCACCTCGCTCAGCGGCTCCCGGGGCCCAGCACCAGCTCAGAATAAAGCGATTC
CACAGCA

FIGURE 96

MGGLLLAAFLALVSVPRAQAVWLGRLDPEQLLGPWYVLAVASREKGFAMEKDMKNVVGVVVT
LTPENNLRTLSSQHGLGGCDQSVMDLIKRNSGWVFENPSIGVLELWVLATNFRDYAIIFTQL
EFGDEPFNTVELYSLTETASQEAMGLFTKWSRSLGFLSQ

Signal peptide:

amino acids 1-20

FIGURE 97

AACAGACGTTCCCTCGCGGCCCTGGCACCTCTAACCCCAGACATGCTGCTGCTGCTGCC
CCTGCTCTGGGGGAGGGAGAGGGCGGAAGGACAGACAAGTAAACTGCTGACGATGCAGAGTT
CCGTGACGGTGCAGGAAGGCCTGTGTGTCCATGTGCCCTGCTCCTTCTCCTACCCCTCGCAT
GGCTGGATTTACCCTGGCCCAGTAGTTCATGGCTACTGGTTCCGGGAAGGGGCCAATACAGA
CCAGGATGCTCCAGTGGCCACAAACAACCCAGCTCGGGCAGTGTGGGAGGAGACTCGGGACC
GATTCCACCTCCTTGGGGACCCACATACCAAGAATTGCACCCTGAGCATCAGAGATGCCAGA
AGAAGTGATGCGGGGAGATACTTCTTTCGTATGGAGAAAGGAAGTATAAAATGGAATTATAA
ACATCACCGGCTCTCTGTGAATGTGACAGCCTTGACCCACAGGCCCAACATCCTCATCCCAG
GCACCCTGGAGTCCGGCTGCCCCCAGAATCTGACCTGCTCTGTGCCCTGGGCCTGTGAGCAG
GGGACACCCCTATGATCTCCTGGATAGGGACCTCCGTGTCCCCCTGGACCCCTCCACCAC
CCGCTCCTCGGTGCTCACCCTCATCCCACAGCCCCAGGACCATGGCACCAGCCTCACCTGTC
AGGTGACCTTCCCTGGGGCCAGCGTGACCACGAACAAGACCGTCCATCTCAACGTGTCCTAC
CCGCCTCAGAACTTGACCATGACTGTCTTCCAAGGAGACGGCACAGTATCCACAGTCTTGGG
AAATGGCTCATCTCTGTCACTCCCAGAGGGCCAGTCTCTGCGCCTGGTCTGTGCAGTTGATG
CAGTTGACAGCAATCCCCCTGCCAGGCTGAGCCTGAGCTGGAGAGGCCTGACCCTGTGCCCC
TCACAGCCCTCAAACCCGGGGGTGCTGGAGCTGCCTTGGGTGCACCTGAGGGATGCAGCTGA
ATTCACCTGCAGAGCTCAGAACCCTCTCGGCTCTCAGCAGGTCTACCTGAACGTCTCCCTGC
AGAGCAAAGCCACATCAGGAGTGACTCAGGGGGTGGTCGGGGGAGCTGGAGCCACAGCCCTG
GTCTTCCTGTCCTTCTGCGTCATCTTCGTTGTAGTGAGGTCCTGCAGGAAGAAATCGGCAAG
GCCAGCAGCGGGCGTGGGAGATACGGGCATAGAGGATGCAAACGCTGTCAGGGGTTCAGCCT
CTCAGGGGCCCCTGACTGAACCTTGGGCAGAAGACAGTCCCCCAGACCAGCCTCCCCCAGCT
TCTGCCCGCTCCTCAGTGGGGGAAGGAGAGCTCCAGTATGCATCCCTCAGCTTCCAGATGGT
GAAGCCTTGGGACTCGCGGGGACAGGAGGCCACTGACACCGAGTACTCGGAGATCAAGATCC
ACAGATGAGAAACTGCAGAGACTCACCCTGATTGAGGGATCACAGCCCCTCCAGGCAAGGGA
GAAGTCAGAGGCTGATTCTTGTAGAATTAACAGCCCTCAACGTGATGAGCTATGATAACACT
ATGAATTATGTGCAGAGTGAAAAGCACACAGGCTTTAGAGTCAAAGTATCTCAAACCTGAAT
CCACACTGTGCCCTCCCTTTTATTTTTTAACTAAAAGACAGACAAATTCCTA

FIGURE 98

MLLLLLPLLWGRERAEGQTSKLLTMQSSVTVQEGLCVHVPCSFSYPSHGWIYPGPVVHGYWF
REGANTDQDAPVATNNPARAVWEETRDRFHLLGDPHTKNCTLSIRDARRSDAGRYFFRMEKG
SIKWNYKHHRLSVNVTALTHRPNILIPGTLESGCPQNLTCSVPWACEQGTPPMISWIGTSVS
PLDPSTTRSSVLTLIPQPQDHGTSLTCQVTFPGASVTTNKTVHLNVSYPPQNLTMTVFQGDG
TVSTVLGNGSSLSLPEGQSLRLVCAVDAVDSNPPARLSLSWRGLTLCPSQPSNPGVLELPWV
HLRDAAEFTCRAQNPLGSQQVYLNVSLQSKATSGVTQGVVGGAGATALVFLSFCVIFVVVRS
CRKKSARPAAGVGDTGIEDANAVRGSASQGPLTEPWAEDSPPDQPPPASARSSVGEGELQYA
SLSFQMVKPWDSRGQEATDTEYSEIKIHR

Signal peptide:

amino acids 1-15

Transmembrane domain:

amino acids 351-370

FIGURE 99

```
GACGCCCAGTGACCTGCCGAGGTCGGCAGCACAGAGCTCTGGAGATGAAGACCCTGTTCCTG
GGTGTCACGCTCGGCCTGGCCGCTGCCCTGTCCTTCACCCTGGAGGAGGAGGATATCACAGG
GACCTGGTACGTGAAGGCCATGGTGGTCGATAAGGACTTTCCGGAGGACAGGAGGCCCAGGA
AGGTGTCCCCAGTGAAGGTGACAGCCCTGGGCGGTGGGAAGTTGGAAGCCACGTTCACCTTC
ATGAGGGAGGATCGGTGCATCCAGAAGAAATCCTGATGCGGAAGACGGAGGAGCCTGGCAA
ATACAGCGCCTATGGGGGCAGGAAGCTCATGTACCTGCAGGAGCTGCCCAGGAGGGACCACT
ACATCTTTTACTGCAAAGACCAGCACCATGGGGGCCTGCTCCACATGGGAAAGCTTGTGGGT
AGGAATTCTGATACCAACCGGGAGGCCCTGGAAGAATTTAAGAAATTGGTGCAGCGCAAGGG
ACTCTCGGAGGAGGACATTTTCACGCCCCTGCAGACGGGAAGCTGCGTTCCCGAACACTAGG
CAGCCCCGGGTCTGCACCTCCAGAGCCCACCCTACCACCAGACACAGAGCCCGGACCACCT
GGACCTACCCTCCAGCCATGACCCTTCCCTGCTCCCACCCACCTGACTCCAAATAAAGTCCT
TTTCCCCCAAAAAAAAAAAAAAAAAAAAAAAAAAAAAAAAAAAAAAAAAAAAAAAAAAAAA
```

FIGURE 100

</usr/seqdb2/sst/DNA/Dnaseqs.min/ss.DNA65404
<subunit 1 of 1, 170 aa, 1 stop
<MW: 19457, pI: 9.10, NX(S/T): 0
MKTLFLGVTLGLAAALSFTLEEEDITGTWYVKAMVVDKDFPEDRRPRKVSPVKVTALGGGKL
EATFTFMREDRCIQKKILMRKTEEPGKYSAYGGRKLMYLQELPRRDHYIFYCKDQHHGGLLH
MGKLVGRNSDTNREALEEFKKLVQRKGLSEEDIFTPLQTGSCVPEH

Important features:

Signal peptide:

amino acids 1-17

FIGURE 101

GTTCCGCAGATGCAGAGGTTGAGGTGGCTGCGGGACTGGAAGTCATCGGGCAGAGGTCTCAC
AGCAGCCAAGGAACCTGGGGCCCGCTCCTCCCCCCTCCAGGCCATGAGGATTCTGCAGTTAA
TCCTGCTTGCTCTGGCAACAGGGCTTGTAGGGGGAGAGACCAGGATCATCAAGGGGTTCGAG
TGCAAGCCTCACTCCCAGCCCTGGCAGGCAGCCCTGTTCGAGAAGACGCGGCTACTCTGTGG
GGCGACGCTCATCGCCCCAGATGGCTCCTGACAGCAGCCCACTGCCTCAAGCCCCGCTACA
TAGTTCACCTGGGGCAGCACAACCTCCAGAAGGAGGAGGGCTGTGAGCAGACCCGGACAGCC
ACTGAGTCCTTCCCCCACCCCGGCTTCAACAACAGCCTCCCCAACAAAGACCACCGCAATGA
CATCATGCTGGTGAAGATGGCATCGCCAGTCTCCATCACCTGGGCTGTGCGACCCCTCACCC
TCTCCTCACGCTGTGTCACTGCTGGCACCAGCTGCCTCATTTCCGGCTGGGGCAGCACGTCC
AGCCCCAGTTACGCCTGCCTCACACCTTGCGATGCGCCAACATCACCATCATTGAGCACCA
GAAGTGTGAGAACGCCTACCCCGGCAACATCACAGACACCATGGTGTGTGCCAGCGTGCAGG
AAGGGGGCAAGGACTCCTGCCAGGGTGACTCCGGGGGCCCTCTGGTCTGTAACCAGTCTCTT
CAAGGCATTATCTCCTGGGGCCAGGATCCGTGTGCGATCACCCGAAAGCCTGGTGTCTACAC
GAAAGTCTGCAAATATGTGGACTGGATCCAGGAGACGATGAAGAACAATTAGACTGGACCCA
CCCACCACAGCCCATCACCCTCCATTTCCACTTGGTGTTTGGTTCCTGTTCACTCTGTTAAT
AAGAAACCCTAAGCCAAGACCCTCTACGAACATTCTTTGGGCCTCCTGGACTACAGGAGATG
CTGTCACTTAATAATCAACCTGGGGTTCGAAATCAGTGAGACCTGGATTCAAATTCTGCCTT
GAAATATTGTGACTCTGGGAATGACAACACCTGGTTTGTTCTCTGTTGTATCCCCAGCCCCA
AAGACAGCTCCTGGCCATATATCAAGGTTTCAATAAATATTTGCTAAATGAAAAAAAAAAAA
AAAAAAAAAAAAAAAAAAAAAAAA

FIGURE 102

```
</usr/seqdb2/sst/DNA/Dnaseqs.min/ss.DNA65405
<subunit 1 of 1, 250 aa, 1 stop
<MW: 27466, pI: 8.87, NX(S/T): 4
MRILQLILLALATGLVGGETRIIKGFECKPHSQPWQAALFEKTRLLCGATLIAPRWLLTAAH
CLKPRYIVHLGQHNLQKEEGCEQTRTATESFPHPGFNNSLPNKDHRNDIMLVKMASPVSITW
AVRPLTLSSRCVTAGTSCLISGWGSTSSPQLRLPHTLRCANITIIEHQKCENAYPGNITDTM
VCASVQEGGKDSCQGDSGGPLVCNQSLQGIISWGQDPCAITRKPGVYTKVCKYVDWIQETMKNN
```

Important features:

Signal peptide:

amino acids 1-18

Serine proteases, trypsin family, histidine active site.

amino acids 58-63

N-glycosylation sites.

amino acids 99-102, 165-168, 181-184, 210-213

Glycosaminoglycan attachment site.

amino acids 145-148

Kringle domain proteins.

amino acids 197-209, 47-64

Serine proteases, trypsin family, histidine protein amino acids 199-209, 47-63, 220-243

Apple domain proteins amino acids 222-249, 189-222

FIGURE 103

GAGCAGTGTTCTGCTGGAGCCGATGCCAAAAACCATGCATTTCTTATTCAGATTCATTGTTT
TCTTTTATCTGTGGGGCCTTTTTACTGCTCAGAGACAAAAGAAAGAGGAGAGCACCGAAGAA
GTGAAAATAGAAGTTTTGCATCGTCCAGAAAACTGCTCTAAGACAAGCAAGAAGGGAGACCT
ACTAAATGCCCATTATGACGGCTACCTGGCTAAAGACGGCTCGAAATTCTACTGCAGCCGGA
CACAAAATGAAGGCCACCCCAAATGGTTTGTTCTTGGTGTTGGGCAAGTCATAAAAGGCCTA
GACATTGCTATGACAGATATGTGCCCTGGAGAAAAGCGAAAAGTAGTTATACCCCCTTCATT
TGCATACGGAAAGGAAGGCTATGCAGAAGGCAAGATTCCACCGGATGCTACATTGATTTTTG
AGATTGAACTTTATGCTGTGACCAAAGGACCACGGAGCATTGAGACATTTAAACAAATAGAC
ATGGACAATGACAGGCAGCTCTCTAAAGCCGAGATAAACCTCTACTTGCAAAGGGAATTTGA
AAAAGATGAGAAGCCACGTGACAAGTCATATCAGGATGCAGTTTTAGAAGATATTTTTAAGA
AGAATGACCATGATGGTGATGGCTTCATTTCTCCCAAGGAATACAATGTATACCAACACGAT
GAACTATAGCATATTTGTATTTCTACTTTTTTTTTTAGCTATTTACTGTACTTTATGTATA
AAACAAAGTCACTTTTCTCCAAGTTGTATTTGCTATTTTTCCCCTATGAGAAGATATTTTGA
TCTCCCCAATACATTGATTTTGGTATAATAAATGTGAGGCTGTTTTGCAAACTTAAAAAAAA
AAAAAAAAAAAAAAAAAAAAAAAAAAAAAAAAAAAA

FIGURE 104

```
</usr/seqdb2/sst/DNA/Dnaseqs.min/ss.DNA65406
<subunit 1 of 1, 222 aa, 1 stop
<MW: 25794, pI: 6.24, NX(S/T): 1
MPKTMHFLFRFIVFFYLWGLFTAQRQKKEESTEEVKIEVLHRPENCSKTSKKGDLLNAHYDG
YLAKDGSKFYCSRTQNEGHPKWFVLGVGQVIKGLDIAMTDMCPGEKRKVVIPPSFAYGKEGY
AEGKIPPDATLIFEIELYAVTKGPRSIETFKQIDMDNDRQLSKAEINLYLQREFEKDEKPRD
KSYQDAVLEDIFKKNDHDGDGFISPKEYNVYQHDEL
```

Important features:

Endoplasmic reticulum targeting sequence.

amino acids 219-222

N-glycosylation site.

amino acids 45-48

FKBP-type peptidyl-prolyl cis-trans isomerase amino acids 87-223, 129-142

EF-hand calcium-binding domain proteins amino acids 202-214, 195-214

FIGURE 105

CAGAAATGCAGGGACCATTGCTTCTTCCAGGCCTCTGCTTTCTGCTGAGCCTCTTTGGAGCT
GTGACTCAGAAAACCAAAACTTCCTGTGCTAAGTGCCCCCCAAATGCTTCCTGTGTCAATAA
CACTCACTGCACCTGCAACCATGGATATACTTCTGGATCTGGGCAGAAACTATTCACATTCC
CCTTGGAGACATGTAACGCCAGGCATGGTGGCTCGCGCCTGTAATCCCAGTTCTTTGGGAAG
CCAAGGCAGGTGGATCACCTGAGGTCAGGAGTTTGAGACCAGCCTGGCCAACATAGTGAAAC
CCCGTGTCTACTAAAAATACAAAAATCAGCCGGGCGTGGTGGTGCATGCCTGCAATCCCAGT
TACTCGGGAGGCTGAGGCAGGAGAATCGCTTGAACTCAGGAGGCAGAAGTTGCAGTGAACCC
AGATCCTGCCATTGCACTCCAGCATGGATGACAGAGCAAGACTCCGTCTCAAAAAGAAAAGA
TAGTTTCTTGTTTCATTTCGCGACTGCCCTCTCAGTGTTTCCTGGGATCCCCTCCCAAATAA
AGTACTTATATTCTC

FIGURE 106

MQGPLLLPGLCFLLSLFGAVTQKTKTSCAKCPPNASCVNNTHCTCNHGYTSGSGQKLFTFPL
ETCNARHGGSRL

Signal peptide:

amino acids 1-18

FIGURE 107

CAAGCAGGTCATCCCCTTGGTGACCTTCAAAGAGAAGCAGAGAGGGCAGAGGTGGGGGGCAC
AGGGAAAGGGTGACCTCTGAGATTCCCCTTTTCCCCCAGACTTTGGAAGTGACCCACCATGG
GGCTCAGCATCTTTTTGCTCCTGTGTGTTCTTGGGCTCAGCCAGGCAGCCACACCGAAGATT
TTCAATGGCACTGAGTGTGGGCGTAACTCACAGCCGTGGCAGGTGGGCTGTTTGAGGGCAC
CAGCCTGCGCTGCGGGGGTGTCCTTATTGACCACAGGTGGGTCCTCACAGCGGCTCACTGCA
GCGGCAGCAGGTACTGGGTGCGCCTGGGGGAACACAGCCTCAGCCAGCTCGACTGGACCGAG
CAGATCCGGCACAGCGGCTTCTCTGTGACCCATCCCGGCTACCTGGGAGCCTCGACGAGCCA
CGAGCACGACCTCCGGCTGCTGCGGCTGCGCCTGCCCGTCCGCGTAACCAGCAGCGTTCAAC
CCCTGCCCCTGCCCAATGACTGTGCAACCGCTGGCACCGAGTGCCACGTCTCAGGCTGGGGC
ATCACCAACCACCCACGGAACCCATTCCCGGATCTGCTCCAGTGCCTCAACCTCTCCATCGT
CTCCCATGCCACCTGCCATGGTGTGTATCCCGGGAGAATCACGAGCAACATGGTGTGTGCAG
GCGGCGTCCCGGGGCAGGATGCCTGCCAGGGTGATTCTGGGGGCCCCCTGGTGTGTGGGGA
GTCCTTCAAGGTCTGGTGTCCTGGGGGTCTGTGGGCCCTGTGGACAAGATGGCATCCCTGG
AGTCTACACCTATATTTGCAAGTATGTGGACTGGATCCGGATGATCATGAGGAACAACTGAC
CTGTTTCCTCCACCTCCACCCCCACCCCTTAACTTGGGTACCCCTCTGGCCCTCAGAGCACC
AATATCTCCTCCATCACTTCCCCTAGCTCCACTCTTGTTGGCCTGGGAACTTCTTGGAACTT
TAACTCCTGCCAGCCCTTCTAAGACCCACGAGCGGGGTGAGAGAAGTGTGCAATAGTCTGGA
ATAAATATAAATGAAGGAGGGGCAAAAAAAAAAAAAA

FIGURE 108

MGLSIFLLLCVLGLSQAATPKIFNGTECGRNSQPWQVGLFEGTSLRCGGVLIDHRWVLTAAH
CSGSRYWVRLGEHSLSQLDWTEQIRHSGFSVTHPGYLGASTSHEHDLRLLRLRLPVRVTSSV
QPLPLPNDCATAGTECHVSGWGITNHPRNPFPDLLQCLNLSIVSHATCHGVYPGRITSNMVC
AGGVPGQDACQGDSGGPLVCGGVLQGLVSWGSVGPCGQDGIPGVYTYICKYVDWIRMIMRNN

Signal peptide:
amino acids 1-17

FIGURE 109

```
GCGGCCACACGCAGCTAGCCGGAGCCCGGACCAGGCGCCTGTGCCTCCTCCTCGTCCCTCGC
CGCGTCCGCGAAGCCTGGAGCCGGCGGGAGCCCCGCGCTCGCCATGTCGGGCGAGCTCAGCA
ACAGGTTCCAAGGAGGGAAGGCGTTCGGCTTGCTCAAAGCCCGGCAGGAGAGGAGGCTGGCC
GAGATCAACCGGGAGTTTCTGTGTGACCAGAAGTACAGTGATGAAGAGAACCTTCCAGAAAA
GCTCACAGCCTTCAAAGAGAAGTACATGGAGTTTGACCTGAACAATGAAGGCGAGATTGACC
TGATGTCTTTAAAGAGGATGATGGAGAAGCTTGGTGTCCCCAAGACCCACCTGGAGATGAAG
AAGATGATCTCAGAGGTGACAGGAGGGGTCAGTGACACTATATCCTACCGAGACTTTGTGAA
CATGATGCTGGGGAAACGGTCGGCTGTCCTCAAGTTAGTCATGATGTTTGAAGGAAAAGCCA
ACGAGAGCAGCCCCAAGCCAGTTGGCCCCCCTCCAGAGAGAGACATTGCTAGCCTGCCCTGA
GGACCCCGCCTGGACTCCCCAGCCTTCCCACCCCATACCTCCCTCCCGATCTTGCTGCCCTT
CTTGACACACTGTGATCTCTCTCTCTCATTTGTTTGGTCATTGAGGGTTTGTTTGTGTTT
TCATCAATGTCTTTGTAAAGCACAAATTATCTGCCTTAAAGGGGCTCTGGGTCGGGGAATCC
TGAGCCTTGGGTCCCCTCCCTCTCTTCTTCCCTCCTTCCCCGCTCCCTGTGCAGAAGGGCTG
ATATCAAACCAAAAACTAGAGGGGGCAGGGCCAGGGCAGGGAGGCTTCCAGCCTGTGTTCCC
CTCACTTGGAGGAACCAGCACTCTCCATCCTTTCAGAAAGTCTCCAAGCCAAGTTCAGGCTC
ACTGACCTGGCTCTGACGAGGACCCCAGGCCACTCTGAGAAGACCTTGGAGTAGGGACAAGG
CTGCAGGGCCTCTTTCGGGTTTCCTTGGACAGTGCCATGGTTCCAGTGCTCTGGTGTCACCC
AGGACACAGCCACTCGGGGCCCCGCTGCCCCAGCTGATCCCCACTCATTCCACACCTCTTCT
CATCCTCAGTGATGTGAAGGTGGGAAGGAAAGGAGCTTGGCATTGGGAGCCCTTCAAGAAGG
TACCAGAAGGAACCCTCCAGTCCTGCTCTCTGGCCACACCTGTGCAGGCAGCTGAGAGGCAG
CGTGCAGCCCTACTGTCCCTTACTGGGGCAGCAGAGGGCTTCGGAGGCAGAAGTGAGGCCTG
GGGTTTGGGGGGAAAGGTCAGCTCAGTGCTGTTCCACCTTTTAGGGAGGATACTGAGGGGAC
CAGGATGGGAGAATGAGGAGTAAAATGCTCACGGCAAAGTCAGCAGCACTGGTAAGCCAAGA
CTGAGAAATACAAGGTTGCTTGTCTGACCCCAATCTGCTTGAAAAAAAAAAAAAAAAA
```

FIGURE 110

MSGELSNRFQGGKAFGLLKARQERRLAEINREFLCDQKYSDEENLPEKLTAFKEKYMEFDLN
NEGEIDLMSLKRMMEKLGVPKTHLEMKKMISEVTGGVSDTISYRDFVNMMLGKRSAVLKLVM
MFEGKANESSPKPVGPPPERDIASLP

FIGURE 111A

```
CGCGCTCCCCGCGCGCCTCCTCGGGCTCCACGCGTCTTGCCCCGCAGAGGCAGCCTCCTCCA
GGAGCGGGGCCCTGCACACCATGGCCCCGGGTGGGCAGGGGTCGGCGCCGCCGTGCGCGCC
CGCCTGGCGCTGGCCTTGGCGCTGGCGAGCGTCCTGAGTGGGCCTCCAGCCGTCGCCTGCCC
CACCAAGTGTACCTGCTCCGCTGCCAGCGTGGACTGCCACGGGCTGGGCCTCCGCGCGGTTC
CTCGGGGCATCCCCCGCAACGCTGAGCGCCTTGACCTGGACAGAAATAATATCACCAGGATC
ACCAAGATGGACTTCGCTGGGCTCAAGAACCTCCGAGTCTTGCATCTGGAAGACAACCAGGT
CAGCGTCATCGAGAGAGGCGCCTTCCAGGACCTGAAGCAGCTAGAGCGACTGCGCCTGAACA
AGAATAAGCTGCAAGTCCTTCCAGAATTGCTTTTCCAGAGCACGCCGAAGCTCACCAGACTA
GATTTGAGTGAAAACCAGATCCAGGGGATCCCGAGGAAGGCGTTCCGCGGCATCACCGATGT
GAAGAACCTGCAACTGGACAACAACCACATCAGCTGCATTGAAGATGGAGCCTTCCGAGCGC
TGCGCGATTTGGAGATCCTTACCCTCAACAACAACAACATCAGTCGCATCCTGGTCACCAGC
TTCAACCACATGCCGAAGATCCGAACTCTGCGCCTCCACTCCAACCACCTCTACTGCGACTG
CCACCTGGCCTGGCTCTCGGATTGGCTGCGACAGCGACGGACAGTTGGCCAGTTCACACTCT
GCATGGCTCCTGTGCATTTGAGGGGCTTCAACGTGGCGGATGTGCAGAAGAAGGAGTACGTG
TGCCCAGCCCCCCACTCGGAGCCCCCATCCTGCAATGCCAACTCCATCTCCTGCCCTTCGCC
CTGCACGTGCAGCAATAACATCGTGGACTGTCGAGGAAAGGGCTTGATGGAGATTCCTGCCA
ACTTGCCGGAGGGCATCGTCGAAATACGCCTAGAACAGAACTCCATCAAAGCCATCCCTGCA
GGAGCCTTCACCCAGTACAAGAAACTGAAGCGAATAGACATCAGCAAGAATCAGATATCGGA
TATTGCTCCAGATGCCTTCCAGGGCCTGAAATCACTCACATCGCTGGTCCTGTATGGGAACA
AGATCACCGAGATTGCCAAGGGACTGTTTGATGGGCTGGTGTCCCTACAGCTGCTCCTCCTC
AATGCCAACAAGATCAACTGCCTGCGGGTGAACACGTTTCAGGACCTGCAGAACCTCAACTT
GCTCTCCCTGTATGACAACAAGCTGCAGACCATCAGCAAGGGGCTCTTCGCCCTCTGCAGT
CCATCCAGACACTCCACTTAGCCCAAAACCCATTTGTGTGCGACTGCCACTTGAAGTGGCTG
GCCGACTACCTCCAGGACAACCCCATCGAGACAAGCGGGGCCCGCTGCAGCAGCCCGCGCCG
ACTCGCCAACAAGCGCATCAGCCAGATCAAGAGCAAGAAGTTCCGCTGCTCAGGCTCCGAGG
ATTACCGCAGCAGGTTCAGCAGCGAGTGCTTCATGGACCTCGTGTGCCCCGAGAAGTGTCGC
TGTGAGGGCACGATTGTGGACTGCTCCAACCAGAAGCTGGTCCGCATCCCAAGCCACCTCCC
TGAATATGTCACCGACCTGCGACTGAATGACAATGAGGTATCTGTTCTGGAGGCCACTGGCA
TCTTCAAGAAGTTGCCCAACCTGCGGAAAATAAATCTGAGTAACAATAAGATCAAGGAGGTG
CGAGAGGGAGCTTTCGATGGAGCAGCCAGCGTGCAGGAGCTGATGCTGACAGGGAACCAGCT
GGAGACCGTGCACGGGCGCGTGTTCCGTGGCCTCAGTGGCCTCAAAACCTTGATGCTGAGGA
GTAACTTGATCAGCTGTGTGAGTAATGACACCTTTGCCGGCCTGAGTTCGGTGAGACTGCTG
TCCCTCTATGACAATCGGATCACCACCATCACCCCTGGGGCCTTCACCACGCTTGTCTCCCT
GTCCACCATAAACCTCCTGTCCAACCCCTTCAACTGCAACTGCCACCTGGCCTGGCTCGGCA
AGTGGTTGAGGAAGAGGCGGATCGTCAGTGGGAACCCTAGGTGCCAGAAGCCATTTTTCCTC
AAGGAGATTCCCATCCAGGATGTGGCCATCCAGGACTTCACCTGTGATGGCAACGAGGAGAG
TAGCTGCCAGCTGAGCCCGCGCTGCCCGGAGCAGTGCACCTGTATGGAGACAGTGGTGCGAT
GCAGCAACAAGGGGCTCCGCGCCCTCCCCAGAGGCATGCCCAAGGATGTGACCGAGCTGTAC
CTGGAAGGAAACCACCTAACAGCCGTGCCCAGAGAGCTGTCCGCCCTCCGACACCTGACGCT
TATTGACCTGAGCAACAACAGCATCAGCATGCTGACCAATTACACCTTCAGTAACATGTCTC
ACCTCTCCACTCTGATCCTGAGCTACAACCGGCTGAGGTGCATCCCCGTCCACGCCTTCAAC
GGGCTGCGGTCCCTGCGAGTGCTAACCCTCCATGGCAATGACATTTCCAGCGTTCCTGAAGG
CTCCTTCAACGACCTCACATCTCTTTCCCATCTGGCGCTGGGAACCAACCCACTCCACTGTG
ACTGCAGTCTTCGGTGGCTGTCGGAGTGGGTGAAGGCGGGGTACAAGGAGCCTGGCATCGCC
CGCTGCAGTAGCCCTGAGCCCATGGCTGACAGGCTCCTGCTCACCACCCCAACCCACCGCTT
CCAGTGCAAAGGGCCAGTGGACATCAACATTGTGGCCAAATGCAATGCCTGCCTCTCCAGCC
CGTGCAAGAATAACGGGACATGCACCCAGGACCCTGTGGAGCTGTACCGCTGTGCCTGCCCC
```

FIGURE 111B

```
TACAGCTACAAGGGCAAGGACTGCACTGTGCCCATCAACACCTGCATCCAGAACCCCTGTCA
GCATGGAGGCACCTGCCACCTGAGTGACAGCCACAAGGATGGGTTCAGCTGCTCCTGCCCTC
TGGGCTTTGAGGGGCAGCGGTGTGAGATCAACCCAGATGACTGTGAGGACAACGACTGCGAA
AACAATGCCACCTGCGTGGACGGGATCAACAACTACGTGTGTATCTGTCCGCCTAACTACAC
AGGTGAGCTATGCGACGAGGTGATTGACCACTGTGTGCCTGAGCTGAACCTCTGTCAGCATG
AGGCCAAGTGCATCCCCCTGGACAAAGGATTCAGCTGCGAGTGTGTCCCTGGCTACAGCGGG
AAGCTCTGTGAGACAGACAATGATGACTGTGTGGCCCACAAGTGCCGCCACGGGCCCAGTG
CGTGGACACAATCAATGGCTACACATGCACCTGCCCCAGGGCTTCAGTGGACCCTTCTGTG
AACACCCCCACCCATGGTCCTACTGCAGACCAGCCCATGCGACCAGTACGAGTGCCAGAAC
GGGGCCCAGTGCATCGTGGTGCAGCAGGAGCCCACCTGCCGCTGCCCACCAGGCTTCGCCGG
CCCCAGATGCGAGAAGCTCATCACTGTCAACTTCGTGGGCAAAGACTCCTACGTGGAACTGG
CCTCCGCCAAGGTCCGACCCCAGGCCAACATCTCCCTGCAGGTGGCCACTGACAAGGACAAC
GGCATCCTTCTCTACAAAGGAGACAATGACCCCCTGGCACTGGAGCTGTACCAGGGCCACGT
GCGGCTGGTCTATGACAGCCTGAGTTCCCCTCCAACCACAGTGTACAGTGTGGAGACAGTGA
ATGATGGGCAGTTTCACAGTGTGGAGCTGGTGACGCTAAACCAGACCCTGAACCTAGTAGTG
GACAAAGGAACTCCAAAGAGCCTGGGGAAGCTCCAGAAGCAGCCAGCAGTGGGCATCAACAG
CCCCCTCTACCTTGGAGGCATCCCCACCTCCACCGGCCTCTCCGCCTTGCGCCAGGGCACGG
ACCGGCCTCTAGGCGGCTTCCACGGATGCATCCATGAGGTGCGCATCAACAACGAGCTGCAG
GACTTCAAGGCCCTCCCACCACAGTCCCTGGGGGTGTCACCAGGCTGCAAGTCCTGCACCGT
GTGCAAGCACGGCCTGTGCCGCTCCGTGGAGAAGGACAGCGTGGTGTGCGAGTGCCGCCCAG
GCTGGACCGGCCCACTCTGCGACCAGGAGGCCCGGGACCCCTGCCTCGGCCACAGATGCCAC
CATGGAAAATGTGTGGCAACTGGGACCTCATACATGTGCAAGTGTGCCGAGGGCTATGGAGG
GGACTTGTGTGACAACAAGAATGACTCTGCCAATGCCTGCTCAGCCTTCAAGTGTCACCATG
GGCAGTGCCACATCTCAGACCAAGGGGAGCCCTACTGCCTGTGCCAGCCCGGCTTTAGCGGC
GAGCACTGCCAACAAGAGAATCCGTGCCTGGGACAAGTAGTCCGAGAGGTGATCCGCCGCCA
GAAAGGTTATGCATCATGTGCCACAGCCTCCAAGGTGCCCATCATGGAATGTCGTGGGGCT
GTGGGCCCCAGTGCTGCCAGCCCACCCGCAGCAAGCGGCGGAAATACGTCTTCCAGTGCACG
GACGGCTCCTCGTTTGTAGAAGAGGTGGAGAGACACTTAGAGTGCGGCTGCCTCGCGTGTTC
CTAAGCCCCTGCCCGCCTGCCTGCCACCTCTCGGACTCCAGCTTGATGGAGTTGGGACAGCC
ATGTGGGACCCCTGGTGATTCAGCATGAAGGAAATGAAGCTGGAGAGGAAGGTAAAGAAGA
AGAGAATATTAAGTATATTGTAAAATAAACAAAAATAGAACTTAAAAAAAAAAAAAAAAA
AAAAAA
```

FIGURE 112

MAPGWAGVGAAVRARLALALALASVLSGPPAVACPTKCTCSAASVDCHGLGLRAVPRGIPRN
AERLDLDRNNITRITKMDFAGLKNLRVLHLEDNQVSVIERGAFQDLKQLERLRLNKNKLQVL
PELLFQSTPKLTRLDLSENQIQGIPRKAFRGITDVKNLQLDNNHISCIEDGAFRALRDLEIL
TLNNNNISRILVTSFNHMPKIRTLRLHSNHLYCDCHLAWLSDWLRQRRTVGQFTLCMAPVHL
RGFNVADVQKKEYVCPAPHSEPPSCNANSISCPSPCTCSNNIVDCRGKGLMEIPANLPEGIV
EIRLEQNSIKAIPAGAFTQYKKLKRIDISKNQISDIAPDAFQGLKSLTSLVLYGNKITEIAK
GLFDGLVSLQLLLLNANKINCLRVNTFQDLQNLNLLSLYDNKLQTISKGLFAPLQSIQTLHL
AQNPFVCDCHLKWLADYLQDNPIETSGARCSSPRRLANKRISQIKSKKFRCSGSEDYRSRFS
SECFMDLVCPEKCRCEGTIVDCSNQKLVRIPSHLPEYVTDLRLNDNEVSVLEATGIFKKLPN
LRKINLSNNKIKEVREGAFDGAASVQELMLTGNQLETVHGRVFRGLSGLKTLMLRSNLISCV
SNDTFAGLSSVRLLSLYDNRITTITPGAFTTLVSLSTINLLSNPFNCNCHLAWLGKWLRKRR
IVSGNPRCQKPFFLKEIPIQDVAIQDFTCDGNEESSCQLSPRCPEQCTCMETVVRCSNKGLR
ALPRGMPKDVTELYLEGNHLTAVPRELSALRHLTLIDLSNNSISMLTNYTFSNMSHLSTLIL
SYNRLRCIPVHAFNGLRSLRVLTLHGNDISSVPEGSFNDLTSLSHLALGTNPLHCDCSLRWL
SEWVKAGYKEPGIARCSSPEPMADRLLLTTPTHRFQCKGPVDINIVAKCNACLSSPCKNNGT
CTQDPVELYRCACPYSYKGKDCTVPINTCIQNPCQHGGTCHLSDSHKDGFSCSCPLGFEGQR
CEINPDDCEDNDCENNATCVDGINNYVCICPPNYTGELCDEVIDHCVPELNLCQHEAKCIPL
DKGFSCECVPGYSGKLCETDNDDCVAHKCRHGAQCVDTINGYTCTCPQGFSGPFCEHPPPMV
LLQTSPCDQYECQNGAQCIVVQQEPTCRCPPGFAGPRCEKLITVNFVGKDSYVELASAKVRP
QANISLQVATDKDNGILLYKGDNDPLALELYQGHVRLVYDSLSSPPTTVYSVETVNDGQFHS
VELVTLNQTLNLVVDKGTPKSLGKLQKQPAVGINSPLYLGGIPTSTGLSALRQGTDRPLGGF
HGCIHEVRINNELQDFKALPPQSLGVSPGCKSCTVCKHGLCRSVEKDSVVCECRPGWTGPLC
DQEARDPCLGHRCHHGKCVATGTSYMCKCAEGYGGDLCDNKNDSANACSAFKCHHGQCHISD
QGEPYCLCQPGFSGEHCQQENPCLGQVVREVIRRQKGYASCATASKVPIMECRGGCGPQCCQ
PTRSKRRKYVFQCTDGSSFVEEVERHLECGCLACS

Signal peptide:
amino acids 1-27

FIGURE 113

GGATGCAGGACGCTCCCCTGAGCTGCCTGTCACCGACTAGGTGGAGCAGTGTTTCTTCCGCA
GACTCAACTGAGAAGTCAGCCTCTGGGGCAGGCACCAGGAATCTGCCTTTTCAGTTCTGTCT
CCGGCAGGCTTTGAGGATGAAGGCTGCGGGCATTCTGACCCTCATTGGCTGCCTGGTCACAG
GCGCCGAGTCCAAAATCTACACTCGTTGCAAACTGGCAAAATATTCTCGAGGGCTGGCCTG
GACAATTACTGGGGCTTCAGCCTTGGAAACTGGATCTGCATGGCATATTATGAGAGCGGCTA
CAACACCACAGCCCCGACGGTCCTGGATGACGGCAGCATCGACTATGGCATCTTCCAGATCA
ACAGCTTCGCGTGGTGCAGACGCGGAAAGCTGAAGGAGAACAACCACTGCCATGTCGCCTGC
TCAGCCTTGATCACTGATGACCTCACAGATGCAATTATCTGTGCCAGGAAAATTGTTAAAGA
GACACAAGGAATGAACTATTGGCAAGGCTGGAAGAAACATTGTGAGGGCAGAGACCTGTCCG
AGTGGAAAAAAGGCTGTGAGGTTTCCTAAACTGGAACTGGACCCAGGATGCTTTGCAGCAAC
GCCCTAGGATTTGCAGTGAATGTCCAAATGCCTGTGTCATCTTGTCCCGTTTCCTCCCAATA
TTCCTTCTCAAACTTGGAGAGGGAAAATTAAGCTATACTTTAAGAAAATAAATATTTCCAT
TTAAATGTC

FIGURE 114

MKAAGILTLIGCLVTGAESKIYTRCKLAKIFSRAGLDNYWGFSLGNWICMAYYESGYNTTAP
TVLDDGSIDYGIFQINSFAWCRRGKLKENNHCHVACSALITDDLTDAIICARKIVKETQGMN
YWQGWKKHCEGRDLSEWKKGCEVS

Signal peptide:
amino acids 1-19

FIGURE 115

CAGGCCATTTGCATCCCACTGTCCTTGTGTTCGGAGCCAGGCCACACCGTCCTCAGCAGTGT
CATGTGTTAAAAACGCCAAGCTGAATATATCATGCCCTATTAAAACTTGTACATGGCTCCC
CATTGGTTTTTGGAGAAAAGTTCAAGCTTTTTACCTTGGTGTCTGCCTGTATCCCAGTGTTC
AGGCTGGCTAGACGGCGGAAGAAGATCCTATTTTACTGTCACTTCCCAGATCTGCTTCTCAC
CAAGAGAGATTCTTTTCTTAAACGACTATACAGGGCCCCAATTGACTGGATAGAGGAATACA
CCACAGGCATGGCAGACTGCATCTTAGTCAACAGCCAGTTCACAGCTGCTGTTTTTAAGGAA
ACATTCAAGTCCCTGTCTCACATAGACCCTGATGTCCTCTATCCATCTCTAAATGTCACCAG
CTTTGACTCAGTTGTTCCTGAAAAGCTGGATGACCTAGTCCCCAAGGGGAAAAAATTCCTGC
TGCTCTCCATCAACAGATACGAAAGGAAGAAAAATCTGACTTTGGCACTGGAAGCCCTAGTA
CAGCTGCGTGGAAGATTGACATCCCAAGATTGGGAGAGGGTTCATCTGATCGTGGCAGGTGG
TTATGACGAGAGAGTCCTGGAGAATGTGGAACATTATCAGGAATTGAAGAAAATGGTCCAAC
AGTCCGACCTTGGCCAGTATGTGACCTTCTTGAGGTCTTTCTCAGACAAACAGAAAATCTCC
CTCCTCCACAGCTGCACGTGTGTGCTTTACACACCAAGCAATGAGCACTTTGGCATTGTCCC
TCTGGAAGCCATGTACATGCAGTGCCCAGTCATTGCTGTTAATTCGGGTGGACCCTTGGAGT
CCATTGACCACAGTGTCACAGGGTTTCTGTGTGAGCCTGACCCGGTGCACTTCTCAGAAGCA
ATAGAAAAGTTCATCCGTGAACCTTCCTTAAAAGCCACCATGGGCCTGGCTGGAAGAGCCAG
AGTGAAGGAAAAATTTTCCCCTGAAGCATTTACAGAACAGCTCTACCGATATGTTACCAAAC
TGCTGGTATAATCAGATTGTTTTAAGATCTCCATTAATGTCATTTTTATGGATTGTAGACC
CAGTTTTGAAACCAAAAAAGAAACCTAGAATCTAATGCAGAAGAGATCTTTTAAAAAATAAA
CTTGAGTCTTGAATGTGAGCCACTTTCCTATATACCACACCTCCCTGTCCACTTTTCAGAAA
AACCATGTCTTTTATGCTATAATCATTCCAAATTTTGCCAGTGTTAAGTTACAAATGTGGTG
TCATTCCATGTTCAGCAGAGTATTTAATTATATTTTCTCGGGATTATTGCTCTTCTGTCTA
TAAATTTTGAATGATACTGTGCCTTAATTGGTTTTCATAGTTTAAGTGTGTATCATTATCAA
AGTTGATTAATTTGGCTTCATAGTATAATGAGAGCAGGGCTATTGTAGTTCCCAGATTCAAT
CCACCGAAGTGTTCACTGTCATCTGTTAGGGAATTTTTGTTTGTCCTGTCTTTGCCTGGATC
CATAGCGAGAGTGCTCTGTATTTTTTTAAGATAATTTGTATTTTTGCACACTGAGATATAA
TAAAAGGTGTTTATCATAAAAAAAAAAAAAAAAAAA

FIGURE 116

MPLLKLVHGSPLVFGEKFKLFTLVSACIPVFRLARRRKKILFYCHFPDLLLTKRDSFLKRLY
RAPIDWIEEYTTGMADCILVNSQFTAAVFKETFKSLSHIDPDVLYPSLNVTSFDSVVPEKLD
DLVPKGKKFLLLSINRYERKKNLTLALEALVQLRGRLTSQDWERVHLIVAGGYDERVLENVE
HYQELKKMVQQSDLGQYVTFLRSFSDKQKISLLHSCTCVLYTPSNEHFGIVPLEAMYMQCPV
IAVNSGGPLESIDHSVTGFLCEPDPVHFSEAIEKFIREPSLKATMGLAGRARVKEKFSPEAF
TEQLYRYVTKLLV

Signal peptide:
amino acids 1-15

FIGURE 117

```
GACTACGCCGATCCGAGACGTGGCTCCCTGGGCGGCAGAACCATGTTGGACTTCGCGATCTT
CGCCGTTACCTTCTTGCTGGCGTTGGTGGGAGCCGTGCTCTACCTCTATCCGGCTTCCAGAC
AAGCTGCAGGAATTCCAGGGATTACTCCAACTGAAGAAAAAGATGGTAATCTTCCAGATATT
GTGAATAGTGGAAGTTTGCATGAGTTCCTGGTTAATTTGCATGAGAGATATGGGCCTGTGGT
CTCCTTCTGGTTTGGCAGGCGCCTCGTGGTTAGTTTGGGCACTGTTGATGTACTGAAGCAGC
ATATCAATCCCAATAAGACATCGGACCCTTTTGAAACCATGCTGAAGTCATTATTAAGGTAT
CAATCTGGTGGTGGCAGTGTGAGTGAAAACCACATGAGGAAAAATTGTATGAAAATGGTGT
GACTGATTCTCTGAAGAGTAACTTTGCCCTCCTCCTAAAGCTTTCAGAAGAATTATTAGATA
AATGGCTCTCCTACCCAGAGACCCAGCACGTGCCCCTCAGCCAGCATATGCTTGGTTTTGCT
ATGAAGTCTGTTACACAGATGGTAATGGGTAGTACATTTGAAGATGATCAGGAAGTCATTCG
CTTCCAGAAGAATCATGGCACAGTTTGGTCTGAGATTGGAAAAGGCTTTCTAGATGGGTCAC
TTGATAAAAACATGACTCGGAAAAAACAATATGAAGATGCCCTCATGCAACTGGAGTCTGTT
TTAAGGAACATCATAAAAGAACGAAAAGGAAGGAACTTCAGTCAACATATTTTCATTGACTC
CTTAGTACAAGGGAACCTTAATGACCAACAGATCCTAGAAGACAGTATGATATTTTCTCTGG
CCAGTTGCATAATAACTGCAAAATTGTGTACCTGGGCAATCTGTTTTTTAACCACCTCTGAA
GAAGTTCAAAAAAAATTATATGAAGAGATAAACCAAGTTTTTGGAAATGGTCCTGTTACTCC
AGAGAAAATTGAGCAGCTCAGATATTGTCAGCATGTGCTTTGTGAAACTGTTCGAACTGCCA
AACTGACTCCAGTTTCTGCCCAGCTTCAAGATATTGAAGGAAAAATTGACCGATTTATTATT
CCTAGAGAGACCCTCGTCCTTTATGCCCTTGGTGTGGTACTTCAGGATCCTAATACTTGGCC
ATCTCCACACAAGTTTGATCCAGATCGGTTTGATGATGAATTAGTAATGAAAACTTTTTCCT
CACTTGGATTCTCAGGCACACAGGAGTGTCCAGAGTTGAGGTTTGCATATATGGTGACCACA
GTACTTCTTAGTGTATTGGTGAAGAGACTGCACCTACTTTCTGTGGAGGGACAGGTTATTGA
AACAAAGTATGAACTGGTAACATCATCAAGGGAAGAAGCTTGGATCACTGTCTCAAAGAGAT
ATTAAAATTTTATACATTTAAAATCATTGTTAAATTGATTGAGGAAAACAACCATTTAAAAA
AAATCTATGTTGAATCCTTTTATAAACCAGTATCACTTTGTAATATAAACACCTATTTGTAC
TTAA
```

FIGURE 118

MLDFAIFAVTFLLALVGAVLYLYPASRQAAGIPGITPTEEKDGNLPDIVNSGSLHEFLVNLH
ERYGPVVSFWFGRRLVVSLGTVDVLKQHINPNKTSDPFETMLKSLLRYQSGGGSVSENHMRK
KLYENGVTDSLKSNFALLLKLSEELLDKWLSYPETQHVPLSQHMLGFAMKSVTQMVMGSTFE
DDQEVIRFQKNHGTVWSEIGKGFLDGSLDKNMTRKKQYEDALMQLESVLRNIIKERKGRNFS
QHIFIDSLVQGNLNDQQILEDSMIFSLASCIITAKLCTWAICFLTTSEEVQKKLYEEINQVF
GNGPVTPEKIEQLRYCQHVLCETVRTAKLTPVSAQLQDIEGKIDRFIIPRETLVLYALGVVL
QDPNTWPSPHKFDPDRFDDELVMKTFSSLGFSGTQECPELRFAYMVTTVLLSVLVKRLHLLS
VEGQVIETKYELVTSSREEAWITVSKRY

Signal peptide:

amino acids 1-18

Transmembrane domain:

amino acids 271-290

FIGURE 119

CTAGATTTGTCGGCTTGCGGGGAGACTTCAGGAGTCGCTGTCTCTGAACTTCCAGCCTCAGA
GACCGCCGCCCTTGTCCCCGAGGGCATGGGCCGGGTCTCAGGGCTTGTGCCCTCTCGCTTC
CTGACGCTCCTGGCGCATCTGGTGGTCGTCATCACCTTATTCTGGTCCCGGGACAGCAACAT
ACAGGCCTGCCTGCCTCTCACGTTCACCCCCGAGGAGTATGACAAGCAGGACATTCAGCTGG
TGGCCGCGCTCTCTGTCACCCTGGGCCTCTTTGCAGTGGAGCTGGCCGGTTTCCTCTCAGGA
GTCTCCATGTTCAACAGCACCCAGAGCCTCATCTCCATTGGGGCTCACTGTAGTGCATCCGT
GGCCCTGTCCTTCTTCATATTCGAGCGTTGGGAGTGCACTACGTATTGGTACATTTTTGTCT
TCTGCAGTGCCCTTCCAGCTGTCACTGAAATGGCTTTATTCGTCACCGTCTTTGGGCTGAAA
AAGAAACCCTTCTGATTACCTTCATGACGGGAACCTAAGGACGAAGCCTACAGGGGCAAGGG
CCGCTTCGTATTCCTGGAAGAAGGAAGGCATAGGCTTCGGTTTTCCCCTCGGAAACTGCTTC
TGCTGGAGGATATGTGTTGGAATAATTACGTCTTGAGTCTGGGATTATCCGCATTGTATTTA
GTGCTTTGTAATAAAATATGTTTTGTAGTAACATTAAGACTTATATACAGTTTTAGGGGACA
ATTAAAAAAAAAAAA

FIGURE 120

MGRVSGLVPSRFLTLLAHLVVVITLFWSRDSNIQACLPLTFTPEEYDKQDIQLVAALSVTLG
LFAVELAGFLSGVSMFNSTQSLISIGAHCSASVALSFFIFERWECTTYWYIFVFCSALPAVT
EMALFVTVFGLKKKPF

Transmembrane domain:

amino acids 12-28 (type II), 51-66, 107-124

FIGURE 121

TCCCGGACCCTGCCGCCCTGCCACTATGTCCCGCCGCTCTATGCTGCTTGCCTGGGCTCTCC
CCAGCCTCCTTCGACTCGGAGCGGCTCAGGAGACAGAAGACCCGGCCTGCTGCAGCCCCATA
GTGCCCCGGAACGAGTGGAAGGCCCTGGCATCAGAGTGCGCCCAGCACCTGAGCCTGCCCTT
ACGCTATGTGGTGGTATCGCACACGGCGGGCAGCAGCTGCAACACCCCGCCTCGTGCCAGC
AGCAGGCCCGGAATGTGCAGCACTACCACATGAAGACACTGGGCTGGTGCGACGTGGGCTAC
AACTTCCTGATTGGAGAAGACGGGCTCGTATACGAGGGCCGTGGCTGGAACTTCACGGGTGC
CCACTCAGGTCACTTATGGAACCCCATGTCCATTGGCATCAGCTTCATGGGCAACTACATGG
ATCGGGTGCCCACACCCCAGGCCATCCGGGCAGCCCAGGGTCTACTGGCCTGCGGTGTGGCT
CAGGGAGCCCTGAGGTCCAACTATGTGCTCAAAGGACACCGGGATGTGCAGCGTACACTCTC
TCCAGGCAACCAGCTCTACCACCTCATCCAGAATTGGCCACACTACCGCTCCCCCTGAGGCC
CTGCTGATCCGCACCCCATTCCTCCCCTCCCATGGCCAAAAACCCCACTGTCTCCTTCTCCA
ATAAAGATGTAGCTC

FIGURE 122

MSRRSMLLAWALPSLLRLGAAQETEDPACCSPIVPRNEWKALASECAQHLSLPLRYVVVSHT
AGSSCNTPASCQQQARNVQHYHMKTLGWCDVGYNFLIGEDGLVYEGRGWNFTGAHSGHLWNP
MSIGISFMGNYMDRVPTPQAIRAAQGLLACGVAQGALRSNYVLKGHRDVQRTLSPGNQLYHL
IQNWPHYRSP

Signal peptide:
amino acids 1-20

FIGURE 123

```
CTGGGACCCCGAAAAGAGAAGGGGAGAGCGAGGGGACGAGAGCGGAGGAGGAAGATGCAACT
GACTCGCTGCTGCTTCGTGTTCCTGGTGCAGGGTAGCCTCTATCTGGTCATCTGTGGCCAGG
ATGATGGTCCTCCCGGCTCAGAGGACCCTGAGCGTGATGACCACGAGGGCCAGCCCCGGCCC
CGGGTGCCTCGGAAGCGGGGCCACATCTCACCTAAGTCCCGCCCCATGGCCAATTCCACTCT
CCTAGGGCTGCTGGCCCCGCCTGGGGAGGCTTGGGGCATTCTTGGGCAGCCCCCAACCGCC
CGAACCACAGCCCCCACCCTCAGCCAAGGTGAAGAAAATCTTTGGCTGGGGCGACTTCTAC
TCCAACATCAAGACGGTGGCCCTGAACCTGCTCGTCACAGGGAAGATTGTGGACCATGGCAA
TGGGACCTTCAGCGTCCACTTCCAACACAATGCCACAGGCCAGGGAAACATCTCCATCAGCC
TCGTGCCCCCCAGTAAAGCTGTAGAGTTCCACCAGGAACAGCAGATCTTCATCGAAGCCAAG
GCCTCCAAAATCTTCAACTGCCGGATGGAGTGGGAGAAGGTAGAACGGGGCCGCCGGACCTC
GCTTTGCACCCACGACCCAGCCAAGATCTGCTCCCGAGACCACGCTCAGAGCTCAGCCACCT
GGAGCTGCTCCCAGCCCTTCAAAGTCGTCTGTGTCTACATCGCCTTCTACAGCACGGACTAT
CGGCTGGTCCAGAAGGTGTGCCCAGATTACAACTACCATAGTGATACCCCTACTACCCATC
TGGGTGACCCGGGGCAGGCCACAGAGGCCAGGCCAGGGCTGGAAGGACAGGCCTGCCCATGC
AGGAGACCATCTGGACACCGGGCAGGGAAGGGGTTGGGCCTCAGGCAGGGAGGGGGTGGAG
ACGAGGAGATGCCAAGTGGGGCCAGGGCCAAGTCTCAAGTGGCAGAGAAAGGGTCCCAAGTG
CTGGTCCCAACCTGAAGCTGTGGAGTGACTAGATCACAGGAGCACTGGAGGAGGAGTGGGCT
CTCTGTGCAGCCTCACAGGGCTTTGCCACGGAGCCACAGAGAGATGCTGGGTCCCCGAGGCC
TGTGGGCAGGCCGATCAGTGTGGCCCCAGATCAAGTCATGGGAGGAAGCTAAGCCCTTGGTT
CTTGCCATCCTGAGGAAAGATAGCAACAGGGAGGGGAGATTTCATCAGTGTGGACAGCCTG
TCAACTTAGGATGGATGGCTGAGAGGGCTTCCTAGGAGCCAGTCAGCAGGGTGGGGTGGGGC
CAGAGGAGCTCTCCAGCCCTGCCTAGTGGGCGCCCTGAGCCCCTTGTCGTGTGCTGAGCATG
GCATGAGGCTGAAGTGGCAACCCTGGGGTCTTTGATGTCTTGACAGATTGACCATCTGTCTC
CAGCCAGGCCACCCCTTTCCAAAATTCCCTCTTCTGCCAGTACTCCCCCTGTACCACCCATT
GCTGATGGCACACCCATCCTTAAGCTAAGACAGGACGATTGTGGTCCTCCCACACTAAGGCC
ACAGCCCATCCGCGTGCTGTGTGTCCCTCTTCCACCCCAACCCCTGCTGGCTCCTCTGGGAG
CATCCATGTCCCGGAGAGGGTCCCTCAACAGTCAGCCTCACCTGTCAGACCGGGGTTCTCC
CGGATCTGGATGGCGCCGCCCTCTCAGCAGCGGGCACGGGTGGGGCGGGGCCGGGCCGCAGA
GCATGTGCTGGATCTGTTCTGTGTGTCTGTCTGTGGGTGGGGGAGGGGAGGGAAGTCTTGT
GAAACCGCTGATTGCTGACTTTTGTGTGAAGAATCGTGTTCTTGGAGCAGGAAATAAAGCTT
GCCCCGGGGCA
```

FIGURE 124

```
></usr/seqdb2/sst/DNA/Dnaseqs.min/ss.DNA66521
><subunit 1 of 1, 252 aa, 1 stop
><MW: 28127, pI: 8.91, NX(S/T): 5
MQLTRCCFVFLVQGSLYLVICGQDDGPPGSEDPERDDHEGQPRPRVPRKRGHISPKSRPMAN
STLLGLLAPPGEAWGILGQPPNRPNHSPPPSAKVKKIFGWGDFYSNIKTVALNLLVTGKIVD
HGNGTFSVHFQHNATGQGNISISLVPPSKAVEFHQEQQIFIEAKASKIFNCRMEWEKVERGR
RTSLCTHDPAKICSRDHAQSSATWSCSQPFKVVCVYIAFYSTDYRLVQKVCPDYNYHSDTPY
YPSG
```

Important features of the protein:
Signal peptide:
amino acids 1-14

N-glycosylation sites.
amino acids 62-65, 127-130, 137-140, 143-146

2-oxo acid dehydrogenases acyltransferase
amino acids 61-71

FIGURE 125

```
GTGAATGTGAGGGTTTGATGACTTTCAGATGTCTAGGAACCAGAGTGGGTGCAGGGGCCCCA
GGCAGGGCTGATTCTTGGGCGGAGGAGAGTAGGGTAAAGGGTTCTGCATGAGCTCCTTAAAG
GACAAAGGTAACAGAGCCAGCGAGAGAGCTCGAGGGGAGACTTTGACTTCAAGCCACAGAAT
TGGTGGAAGTGTGCGCGCCGCCGCCGCCGTCGCTCCTGCAGCGCTGTCGACCTAGCCGCTAG
CATCTTCCCGAGCACCGGGATCCCGGGGTAGGAGGCGACGCGGGCGAGCACCAGCGCCAGCC
GGCTGCGGCTGCCCACACGGCTCACCATGGGCTCCGGGCGCCGGGCGCTGTCCGCGGTGCCG
GCCGTGCTGCTGGTCCTCACGCTGCCGGGGCTGCCCGTCTGGGCACAGAACGACACGGAGCC
CATCGTGCTGGAGGGCAAGTGTCTGGTGGTGTGCGACTCGAACCCGGCCACGGACTCCAAGG
GCTCCTCTTCCTCCCCGCTGGGGATATCGGTCCGGGCGGCCAACTCCAAGGTCGCCTTCTCG
GCGGTGCGGAGCACCAACCACGAGCCATCCGAGATGAGCAACAAGACGCGCATCATTTACTT
CGATCAGATCCTGGTGAATGTGGGTAATTTTTTCACATTGGAGTCTGTCTTTGTAGCACCAA
GAAAAGGAATTTACAGTTTCAGTTTTCACGTGATTAAAGTCTACCAGAGCCAAACTATCCAG
GTTAACTTGATGTTAAATGGAAAACCAGTAATATCTGCCTTTGCGGGGACAAAGATGTTAC
TCGTGAAGCTGCCACGAATGGTGTCCTGCTCTACCTAGATAAAGAGGATAAGGTTTACCTAA
AACTGGAGAAAGGTAATTTGGTTGGAGGCTGGCAGTATTCCACGTTTTCTGGCTTTCTGGTG
TTCCCCCTATAGGATTCAATTTCTCCATGATGTTCATCCAGGTGAGGGATGACCCACTCCTG
AGTTATTGGAAGATCATTTTTTCATCATTGGATTGATGTCTTTTATTGGTTTCTCATGGGTG
GATATGGATTCTAAGGATTCTAGCCTGTCTGAACCAATACAAAATTTCACAGATTATTTGTG
TGTGTCTGTTTCAGTATATTTGGATTGGGACTCTAAGCAGATAATACCTATGCTTAAATGTA
ACAGTCAAAGCTGTCTGCAAGACTTATTCTGAATTTCATTTCCTGGGATTACTGAATTAGT
TACAGATGTGGAATTTTATTTGTTTAGTTTTAAAAGACTGGCAACCAGGTCTAAGGATTAGA
AAACTCTAAAGTTCTGACTTCAATCAACGGTTAGTGTGATACTGCCAAAGAACTGTATACTG
TGTTAATATATTGATTATATTTGTTTTTATTCCTTTGGAATTAGTTTGTTTGGTTCTTGTAA
AAAACTTGGATTTTTTTTTTCAGTAACTGGTATTATGTTTTCTCTTAAAATAAGGTAATGAA
TGGCTTGCCCACAAATTTACCTTGACTACGATATCATCGACATGACTTCTCTCAAAAAAAAA
GAATGCTTCATAGTTGTATTTTAATTGTATATGTGAAAGAGTCATATTTTCCAAGTTATATT
TTCTAAGAAGAAGAATAGATCATAAATCTGACAAGGAAAAAGTTGCTTACCCAAAATCTAAG
TGCTCAATCCCTGAGCCTCAGCAAACAGCTCCCCTCCGAGGGAAATCTTATACTTTATTGC
TCAACTTTAATTAAAATGATTGATAATAACCACTTTATTAAAAACCTAAGGTTTTTTTTTT
TCCGTAGACATGACCACTTTATTAACTGGTGGTGGGATGCTGTTGTTTCTAATTATACCTAT
TTTTCAAGGCTTCTGTTGTATTTGAAGTATCATCTGGTTTTGCCTTAACTCTTTAAATTGTA
TATATTTATCTGTTTAGCTAATATTAAATTCAAATATCCCATATCTAAATTTAGTGCAATAT
CTTGTCTTTTGTATAGGTCATATGAATTCATAAAATTATTTATGTCTGTTATAGAATAAAGA
TTAATATATGTTAAAAAAA
```

FIGURE 126

MGSGRRALSAVPAVLLVLTLPGLPVWAQNDTEPIVLEGKCLVVCDSNPATDSKGSSSSPLGI
SVRAANSKVAFSAVRSTNHEPSEMSNKTRIIYFDQILVNVGNFFTLESVFVAPRKGIYSFSF
HVIKVYQSQTIQVNLMLNGKPVISAFAGDKDVTREAATNGVLLYLDKEDKVYLKLEKGNLVG
GWQYSTFSGFLVFPL

Signal peptide:
amino acids 1-27

FIGURE 127

CGGTGGCCATGACTGCGGCCGTGTTCTTCGGCTGCGCCTTCATTGCCTTCGGGCCTGCGCTC
GCCCTTTATGTCTTCACCATCGCCATCGAGCCGTTGCGTATCATCTTCCTCATCGCCGGAGC
TTTCTTCTGGTTGGTGTCTCTACTGATTTCGTCCCTTGTTTGGTTCATGGCAAGAGTCATTA
TTGACAACAAAGATGGACCAACACAGAAATATCTGCTGATCTTTGGAGCGTTTGTCTCTGTC
TATATCCAAGAAATGTTCCGATTTGCATATTATAAACTCTTAAAAAAGCCAGTGAAGGTTT
GAAGAGTATAAACCCAGGTGAGACAGCACCCTCTATGCGACTGCTGGCCTATGTTTCTGGCT
TGGGCTTTGGAATCATGAGTGGAGTATTTTCCTTTGTAATACCCTATCTGACTCCTTGGGG
CCAGGCACAGTGGGCATTCATGGAGATTCTCCTCAATTCTTCCTTTATTCAGCTTTCATGAC
GCTGGTCATTATCTTGCTGCATGTATTCTGGGGCATTGTATTTTTTGATGGCTGTGAGAAGA
AAAAGTGGGGCATCCTCCTTATCGTTCTCCTGACCCACCTGCTGGTGTCAGCCCAGACCTTC
ATAAGTTCTTATTATGGAATAAACCTGGCGTCAGCATTTATAATCCTGGTGCTCATGGGCAC
CTGGGCATTCTTAGCTGCGGGAGGCAGCTGCCGAAGCCTGAAACTCTGCCTGCTCTGCCAAG
ACAAGAACTTTCTTCTTTACAACCAGCGCTCCAGATAACCTCAGGGAACCAGCACTTCCCAA
ACCGCAGACTACATCTTTAGAGGAAGCACAACTGTGCCTTTTCTGAAAATCCCTTTTTCTG
GTGGAATTGAGAAAGAAATAAAACTATGCAGATA

FIGURE 128

```
></usr/seqdb2/sst/DNA/Dnaseqs.min/ss.DNA66658
><subunit 1 of 1, 257 aa, 1 stop
><MW: 28472, pI: 9.33, NX(S/T): 0
MTAAVFFGCAFIAFGPALALYVFTIAIEPLRIIFLIAGAFFWLVSLLISSLVWFMARVIIDN
KDGPTQKYLLIFGAFVSVYIQEMFRFAYYKLLKKASEGLKSINPGETAPSMRLLAYVSGLGF
GIMSGVFSFVNTLSDSLGPGTVGIHGDSPQFFLYSAFMTLVIILLHVFWGIVFFDGCEKKKW
GILLIVLLTHLLVSAQTFISSYYGINLASAFIILVLMGTWAFLAAGGSCRSLKLCLLCQDKN
FLLYNQRSR
```

Important features of the protein:

Signal peptide:

amino acids 1-19

Transmembrane domains:

amino acids 32-51, 119-138, 152-169, 216-235

Glycosaminoglycan attachment site.

amino acids 120-123

Sodium:neurotransmitter symporter family protein amino acids 31-65

FIGURE 129

```
CGGCAACCAGCCGCCGCCACCACCGCTGCCACTGCCGCCCTGCCGGGGCCATGTTCGCTCTGGGCTTGCCCTTCT
TGGTGCTCTTGGTGGCCTCGGTCGAGAGCCATCTGGGGGTTCTGGGGCCCAAGAACGTCTCGCAGAAAGACGCCG
AGTTTGAGCGCACCTACGTGGACGAGGTCAACAGCGAGCTGGTCAACATCTACACCTTCAACCATACTGTGACCC
GCAACAGGACAGAGGGCGTGCGTGTGTCTGTGAACGTCCTGAACAAGCAGAAGGGGGCGCCGTTGCTGTTTGTGG
TCCGCCAGAAGGAGGCTGTGGTGTCCTTCCAGGTGCCCCTAATCCTGCGAGGGATGTTTCAGCGCAAGTACCTCT
ACCAAAAAGTGGAACGAACCCTGTGTCAGCCCCCCACCAAGAATGAGTCGGAGATTCAGTTCTTCTACGTGGATG
TGTCCACCCTGTCACCAGTCAACACCACATACCAGCTCCGGGTCAGCCGCATGGACGATTTTGTGCTCAGGACTG
GGGAGCAGTTCAGCTTCAATACCACAGCAGCACAGCCCCAGTACTTCAAGTATGAGTTCCCTGAAGGCGTGGACT
CGGTAATTGTCAAGGTGACCTCCAACAAGGCCTTCCCCTGCTCAGTCATCTCCATTCAGGATGTGCTGTGTCCTG
TCTATGACCTGGACAACAACGTAGCCTTCATCGGCATGTACCAGACGATGACCAAGAAGGCGGCCATCACCGTAC
AGCGCAAAGACTTCCCCAGCAACAGCTTTTATGTGGTGGTGGTGGTGAAGACCGAAGACCAAGCCTGCGGGGCT
CCCTGCCTTTCTACCCCTTCGCAGAAGATGAACCGGTCGATCAAGGGCACCGCCAGAAAACCCTGTCAGTGCTGG
TGTCTCAAGCAGTCACGTCTGAGGCATACGTCAGTGGGATGCTCTTTTGCCTGGGTATATTTCTCTCCTTTTACC
TGCTGACCGTCCTCCTGGCCTGCTGGGAGAACTGGAGGCAGAAGAAGAAGACCCTGCTGGTGGCCATTGACCGAG
CCTGCCCAGAAAGCGGTCACCCTCGAGTCCTGGCTGATTCTTTTCCTGGCAGTTCCCCTTATGAGGGTTACAACT
ATGGCTCCTTTGAGAATGTTTCTGGATCTACCGATGGTCTGGTTTGACAGCGCTGGCACTGGGGACCTCTCTTACG
GTTACCAGGGCCGCTCCTTTGAACCTGTAGGTACTCGGCCCCGAGTGGACTCCATGAGCTCTGTGGAGGAGGATG
ACTACGACACATTGACCGACATCGATTCCGACAAGAATGTCATTCGCACCAAGCAATACCTCTATGTGGCTGACC
TGGCACGGAAGGACAAGCGTGTTCTGCGGAAAAAGTACCAGATCTACTTCTGGAACATTGCCACCATTGCTGTCT
TCTATGCCCTTCCTGTGGTGCAGCTGGTGATCACCTACCAGACGGTGGTGAATGTCACAGGGAATCAGGACATCT
GCTACTACAACTTCCTCTGCGCCCACCCACTGGGCAATCTCAGCGCCTTCAACAACATCCTCAGCAACCTGGGGT
ACATCCTGCTGGGGCTGCTTTTCCTGCTCATCATCCTGCAACGGGAGATCAACCACAACCGGGCCCTGCTGCGCA
ATGACCTCTGTGCCCTGGAATGTGGGATCCCCAAACACTTTGGGCTTTTCTACGCCATGGGCACAGCCCTGATGA
TGGAGGGGCTGCTCAGTGCTTGCTATCATGTGTGCCCCAACTATACCAATTTCCAGTTTGACACATCGTTCATGT
ACATGATCGCCGGACTCTGCATGCTGAAGCTCTACCAGAAGCGGCACCCGGACATCAACGCCAGCGCCTACAGTG
CCTACGCCTGCCTGGCCATTGTCATCTTCTTCTCTGTGCTGGGCGTGGTCTTTGGCAAAGGGAACACGGCGTTCT
GGATCGTCTTCTCCATCATTCACATCATCGCCACCCTGCTCCTCAGCACGCAGCTCTATTACATGGGCCGGTGGA
AACTGGACTCGGGGATCTTCCGCCGCATCCTCCACGTGCTCTACACAGACTGCATCCGGCAGTGCAGCGGGCCGC
TCTACGTGGACCGCATGGTGCTGCTGGTCATGGGCAACGTCATCAACTGGTCGCTGGCTGCCTATGGGCTTATCA
TGCGCCCCAATGATTTCGCTTCCTACTTGTTGGCCATTGGCATCTGCAACCTGCTCCTTTACTTCGCCTTCTACA
TCATCATGAAGCTCCGGAGTGGGGAGAGGATCAAGCTCATCCCCCTGCTCTGCATCGTTTGCACCTCCGTGGTCT
GGGGCTTCGCGCTCTTCTTCTTCTTCCAGGGACTCAGCACCTGGCAGAAAACCCCTGCAGAGTCGAGGGAGCACA
ACCGGGACTGCATCCTCCTCGACTTCTTTGACGACCACGACATCTGGCACTTCCTCTCCTCCATCGCCATGTTCG
GGTCCTTCCTGGTGTTGCTGACACTGGATGACGACCTGGATACTGTGCAGCGGGACAAGATCTATGTCTTCTAGC
AGGAGCTGGGCCCTTCGCTTCACCTCAAGGGGCCCTGAGCTCCTTTGTGTCATAGACCGGTCACTCGTCGTGCT
GTGGGGATGAGTCCCAGCACCGCTGCCCAGCACTGGATGGCAGCAGGACAGCCAGGTCTAGCTTAGGCTTGGCCT
GGGACAGCCATGGGTGGCATGGAACCTTGCAGCTGCCCTCTGCCCGAGGAGCAGGCCTGCTCCCCTGGAACCCCC
AGATGTTGGCCAAATTGCTGCTTTCTTCTCAGTGTTGGGGCCTTCCATGGGCCCCTGTCCTTTGGCTCTCCATTT
GTCCCTTTGCAAGAGGAAGGATGGAAGGGACACCCTCCCCATTTCATGCCTTGCATTTTGCCCGTCCTCCTCCCC
ACAATGCCCCAGCCTGGGACCTAAGGCCTCTTTTTCCTCCCCATACTCCCACTCCAGGGCCTAGTCTGGGGCCTGA
ATCTCTGTCCTGTATCAGGGCCCCAGTTCTCTTTGGGCTGTCCCTGGCTGCCATCACTGCCCATTCCAGTCAGCC
AGGATGGATGGGGTATGAGATTTTGGGGGTTGGCCAGCTGGTGCCAGACTTTTGGTGCTAAGGCCTGCAAGGGG
CCTGGGGCAGTGCGTATTCTCTTCCCTCTGACCTGTGCTCAGGGCTGGCTCTTTAGCAATGCGCTCAGCCCAATT
TGAGAACCGCCTTCTGATTCAAGAGGCTGAATTCAGAGGTCACCTCTTCATCCCATCAGCTCCCAGACTGATGCC
AGCACCAGGACTGGAGGGAGAAGCGCCTCACCCCTTCCCTTCCTTCTTTCCAGGCCCTTAGTCTTGCCAAACCCC
AGCTGGTGGCCTTTCAGTGCCATTGACACTGCCCAAGAATGTCCAGGGGCAAAGGAGGGATGATACAGAGTTCAG
CCCGTTCTGCCTCCACAGCTGTGGGCACCCCAGTGCCTACCTTAGAAAGGGGCTTCAGGAAGGGATGTGCTGTTT
CCCTCTACGTGCCCAGTCCTAGCCTCGCTCTAGGACCCAGGGCTGGCTTCTAAGTTTCCGTCCAGTCTTCAGGCA
AGTTCTGTGTTAGTCATGCACACACATACCTATGAAACCTTGGAGTTTACAAAGAATTGCCCCAGCTCTGGGCAC
CCTGGCCACCCTGGTCCTTGGATCCCCTTCGTCCCACCTGGTCCACCCCAGATGCTGAGGATGGGGAGCTCAGG
CGGGGCCTCTGCTTTGGGGATGGGAATGTGTTTTTCTCCCAAACTTGTTTTTATAGCTCTGCTTGAAGGGCTGGG
AGATGAGGTGGGTCTGGATCTTTTCTCAGAGCGTCTCCATGCTATGGTTGCATTTCCGTTTTCTATGAATGAATT
TGCATTCAATAAACAACCAGACTCAAAAAAAAAAAAAAA
```

FIGURE 130

```
></usr/seqdb2/sst/DNA/Dnaseqs.min/ss.DNA66659
><subunit 1 of 1, 832 aa, 1 stop
><MW: 94454, pI: 6.94, NX(S/T): 12
MFALGLPFLVLLVASVESHLGVLGPKNVSQKDAEFERTYVDEVNSELVNIYTFNHTVTRNRT
EGVRVSVNVLNKQKGAPLLFVVRQKEAVVSFQVPLILRGMFQRKYLYQKVERTLCQPPTKNE
SEIQFFYVDVSTLSPVNTTYQLRVSRMDDFVLRTGEQFSFNTTAAQPQYFKYEFPEGVDSVI
VKVTSNKAFPCSVISIQDVLCPVYDLDNNVAFIGMYQTMTKKAAITVQRKDFPSNSFYVVVV
VKTEDQACGGSLPFYPFAEDEPVDQGHRQKTLSVLVSQAVTSEAYVSGMLFCLGIFLSFYLL
TVLLACWENWRQKKKTLLVAIDRACPESGHPRVLADSFPGSSPYEGYNYGSFENVSGSTDGL
VDSAGTGDLSYGYQGRSFEPVGTRPRVDSMSSVEEDDYDTLTDIDSDKNVIRTKQYLYVADL
ARKDKRVLRKKYQIYFWNIATIAVFYALPVVQLVITYQTVVNVTGNQDICYYNFLCAHPLGN
LSAFNNILSNLGYILLGLLFLLIILQREINHNRALLRNDLCALECGIPKHFGLFYAMGTALM
MEGLLSACYHVCPNYTNFQFDTSFMYMIAGLCMLKLYQKRHPDINASAYSAYACLAIVIFFS
VLGVVFGKGNTAFWIVFSIIHIIATLLLSTQLYYMGRWKLDSGIFRRILHVLYTDCIRQCSG
PLYVDRMVLLVMGNVINWSLAAYGLIMRPNDFASYLLAIGICNLLLYFAFYIIMKLRSGERI
KLIPLLCIVCTSVVWGFALFFFFQGLSTWQKTPAESREHNRDCILLDFFDDHDIWHFLSSIA
MFGSFLVLLTLDDDLDTVQRDKIYVF
```

Important features of the protein:

Signal peptide:

amino acids 1-18

Transmembrane domains:

amino acids 292-317, 451-470, 501-520, 607-627, 751-770

Leucine zipper pattern.

amino acids 497-518

N-glycosylation sites.

amino acids 27-30, 54-57, 60-63, 123-126, 141-144, 165-168, 364-367, 476-479, 496-499, 572-575, 603-606, 699-702

FIGURE 131

```
GCTCAAGTGCCCTGCCTTGCCCCACCCAGCCCAGCCTGGCCAGAGCCCCCTGGAGAAGGAGC
TCTCTTCTTGCTTGGCAGCTGGACCAAGGGAGCCAGTCTTGGGCGCTGGAGGGCCTGTCCTG
ACCATGGTCCCTGCCTGGCTGTGGCTGCTTTGTGTCTCCGTCCCCCAGGCTCTCCCCAAGGC
CCAGCCTGCAGAGCTGTCTGTGGAAGTTCCAGAAAACTATGGTGGAAATTTCCCTTTATACC
TGACCAAGTTGCCGCTGCCCCGTGAGGGGGCTGAAGGCCAGATCGTGCTGTCAGGGGACTCA
GGCAAGGCAACTGAGGGCCCATTTGCTATGATCCAGATTCTGGCTTCCTGCTGGTGACCAG
GGCCCTGGACCGAGAGGAGCAGGCAGAGTACCAGCTACAGGTCACCCTGGAGATGCAGGATG
GACATGTCTTGTGGGGTCCACAGCCTGTGCTTGTGCACGTGAAGGATGAGAATGACCAGGTG
CCCCATTTCTCTCAAGCCATCTACAGAGCTCGGCTGAGCCGGGGTACCAGGCCTGGCATCCC
CTTCCTCTTCCTTGAGGCTTCAGACCGGGATGAGCCAGGCACAGCCAACTCGGATCTTCGAT
TCCACATCCTGAGCCAGGCTCCAGCCCAGCCTTCCCCAGACATGTTCCAGCTGGAGCCTCGG
CTGGGGGCTCTGGCCCTCAGCCCCAAGGGGAGCACCAGCCTTGACCACGCCCTGGAGAGGAC
CTACCAGCTGTTGGTACAGGTCAAGGACATGGGTGACCAGGCCTCAGGCACCAGGCCACTG
CCACCGTGGAAGTCTCCATCATAGAGAGCACCTGGGTGTCCCTAGAGCCTATCCACCTGGCA
GAGAATCTCAAAGTCCTATACCCGCACCACATGGCCCAGGTACACTGGAGTGGGGGTGATGT
GCACTATCACCTGGAGAGCCATCCCCGGGACCCTTTGAAGTGAATGCAGAGGGAAACCTCT
ACGTGACCAGAGAGCTGGACAGAGAAGCCCAGGCTGAGTACCTGCTCCAGGTGCGGGCTCAG
AATTCCCATGGCGAGGACTATGCGGCCCTCTGGAGCTGCACGTGCTGGTGATGGATGAGAA
TGACAACGTGCCTATCTGCCCTCCCCGTGACCCCACAGTCAGCATCCCTGAGCTCAGTCCAC
CAGGTACTGAAGTGACTAGACTGTCAGCAGAGGATGCAGATGCCCCCGGCTCCCCCAATTCC
CACGTTGTGTATCAGCTCCTGAGCCCTGAGCCTGAGGATGGGGTAGAGGGGAGAGCCTTCCA
GGTGGACCCCACTTCAGGCAGTGTGACGCTGGGGGTGCTCCCACTCCGAGCAGGCCAGAACA
TCCTGCTTCTGGTGCTGGCCATGGACCTGGCAGGCGCAGAGGGTGGCTTCAGCAGCACGTGT
GAAGTCGAAGTCGCAGTCACAGATATCAATGATCACGCCCCTGAGTTCATCACTTCCCAGAT
TGGGCCTATAAGCCTCCCTGAGGATGTGGAGCCCGGGACTCTGGTGGCCATGCTAACAGCCA
TTGATGCTGACCTCGAGCCCGCCTTCCGCCTCATGGATTTTGCCATTGAGAGGGGAGACACA
GAAGGGACTTTTGGCCTGGATTGGGAGCCAGACTCTGGGCATGTTAGACTCAGACTCTGCAA
GAACCTCAGTTATGAGGCAGCTCCAAGTCATGAGGTGGTGGTGGTGGTGCAGAGTGTGGCGA
AGCTGGTGGGGCCAGGCCCAGGCCCTGGAGCCACCGCCACGGTGACTGTGCTAGTGGAGAGA
GTGATGCCACCCCCCAAGTTGGACCAGGAGAGCTACGAGGCCAGTGTCCCCATCAGTGCCCC
AGCCGGCTCTTTCCTGCTGACCATCCAGCCCTCCGACCCCATCAGCCGAACCCTCAGGTTCT
CCCTAGTCAATGACTCAGAGGGCTGGCTCTGCATTGAGAAATTCTCCGGGGAGGTGCACACC
GCCCAGTCCCTGCAGGGCGCCCAGCCTGGGACACCTACACGGTGCTTGTGGAGGCCCAGGA
TACAGCCCTGACTCTTGCCCCTGTGCCCTCCCAATACCTCTGCACACCCCGCCAAGACCATG
GCTTGATCGTGAGTGGACCCAGCAAGGACCCCGATCTGGCCAGTGGGCACGGTCCCTACAGC
TTCACCCTTGGTCCCAACCCCACGGTGCAACGGGATTGGCGCCTCCAGACTCTCAATGGTTC
CCATGCCTACCTCACCTTGGCCCTGCATTGGGTGGAGCCACGTGAACACATAATCCCCGTGG
TGGTCAGCCACAATGCCCAGATGTGGCAGCTCCTGGTTCGAGTGATCGTGTGTCGCTGCAAC
GTGGAGGGGCAGTGCATGCGCAAGGTGGGCCGCATGAAGGGCATGCCCACGAAGCTGTCGGC
AGTGGGCATCCTTGTAGGCACCCTGGTAGCAATAGGAATCTTCCTCATCCTCATTTTCACCC
ACTGGACCATGTCAAGGAAGAAGGACCCGGATCAACCAGCAGACAGCGTGCCCCTGAAGGCG
ACTGTCTGAATGGCCCAGGCAGCTCTAGCTGGGAGCTTGGCCTCTGGCTCCATCTGAGTCCC
CTGGGAGAGAGCCCAGCACCCAAGATCCAGCAGGGGACAGGACAGAGTAGAAGCCCCTCCAT
CTGCCCTGGGGTGGAGGCACCATCACCATCACCAGGCATGTCTGCAGAGCCTGGACACCAAC
TTTATGGACTGCCCATGGGAGTGCTCCAAATGTCAGGGTGTTTGCCCAATAATAAAGCCCCA
GAGAACTGGGCTGGGCCCTATGGGAAAAAAAAAAAAAAAAAAAAAAAAAAAAAAAAAAAAAG
```

FIGURE 132

MVPAWLWLLCVSVPQALPKAQPAELSVEVPENYGGNFPLYLTKLPLPREGAEGQIVLSGDSG
KATEGPFAMDPDSGFLLVTRALDREEQAEYQLQVTLEMQDGHVLWGPQPVLVHVKDENDQVP
HFSQAIYRARLSRGTRPGIPFLFLEASDRDEPGTANSDLRFHILSQAPAQPSPDMFQLEPRL
GALALSPKGSTSLDHALERTYQLLVQVKDMGDQASGHQATATVEVSIIESTWVSLEPIHLAE
NLKVLYPHHMAQVHWSGGDVHYHLESHPPGPFEVNAEGNLYVTRELDREAQAEYLLQVRAQN
SHGEDYAAPLELHVLVMDENDNVPICPPRDPTVSIPELSPPGTEVTRLSAEDADAPGSPNSH
VVYQLLSPEPEDGVEGRAFQVDPTSGSVTLGVLPLRAGQNILLLVLAMDLAGAEGGFSSTCE
VEVAVTDINDHAPEFITSQIGPISLPEDVEPGTLVAMLTAIDADLEPAFRLMDFAIERGDTE
GTFGLDWEPDSGHVRLRLCKNLSYEAAPSHEVVVVVQSVAKLVGPGPGPGATATVTVLVERV
MPPPKLDQESYEASVPISAPAGSFLLTIQPSDPISRTLRFSLVNDSEGWLCIEKFSGEVHTA
QSLQGAQPGDTYTVLVEAQDTALTLAPVPSQYLCTPRQDHGLIVSGPSKDPDLASGHGPYSF
TLGPNPTVQRDWRLQTLNGSHAYLTLALHWVEPREHIIPVVVSHNAQMWQLLVRVIVCRCNV
EGQCMRKVGRMKGMPTKLSAVGILVGTLVAIGIFLILIFTHWTMSRKKDPDQPADSVPLKATV

Signal peptide:
amino acids 1-18

Transmembrane domain:
amino acids 762-784

FIGURE 133

```
CCGGGGACATGAGGTGGATACTGTTCATTGGGGCCCTTATTGGGTCCAGCATCTGTGGCCAA
GAAAAATTTTTGGGGACCAAGTTTTGAGGATTAATGTCAGAAATGGAGACGAGATCAGCAA
ATTGAGTCAACTAGTGAATTCAAACAACTTGAAGCTCAATTTCTGGAAATCTCCCTCCTCCT
TCAATCGGCCTGTGGATGTCCTGGTCCCATCTGTCAGTCTGCAGGCATTTAAATCCTTCCTG
AGATCCCAGGGCTTAGAGTACGCAGTGACAATTGAGGACCTGCAGGCCCTTTTAGACAATGA
AGATGATGAAATGCAACACAATGAAGGGCAAGAACGGAGCAGTAATAACTTCAACTACGGGG
CTTACCATTCCCTGGAAGCTATTTACCACGAGATGGACAACATTGCCGCAGACTTTCCTGAC
CTGGCGAGGAGGGTGAAGATTGGACATTCGTTTGAAAACCGGCCGATGTATGTACTGAAGTT
CAGCACTGGGAAAGGCGTGAGGCGGCCGGCCGTTTGGCTGAATGCAGGCATCCATTCCCGAG
AGTGGATCTCCCAGGCCACTGCAATCTGGACGGCAAGGAAGATTGTATCTGATTACCAGAGG
GATCCAGCTATCACCTCCATCTTGGAGAAAATGGATATTTTCTTGTTGCCTGTGGCCAATCC
TGATGGATATGTGTATACTCAAACTCAAAACCGATTATGGAGGAAGACGCGGTCCCGAAATC
CTGGAAGCTCCTGCATTGGTGCTGACCCAAATAGAAACTGGAACGCTAGTTTTGCAGGAAAG
GGAGCCAGCGACAACCCTTGCTCCGAAGTGTACCATGGACCCCACGCCAATTCGGAAGTGGA
GGTGAAATCAGTGGTAGATTTCATCCAAAAACATGGGAATTTCAAGGGCTTCATCGACCTGC
ACAGCTACTCGCAGCTGCTGATGTATCCATATGGGTACTCAGTCAAAAAGGCCCCAGATGCC
GAGGAACTCGACAAGGTGGCGAGGCTTGCGGCCAAAGCTCTGGCTTCTGTGTCGGGCACTGA
GTACCAAGTGGGTCCCACCTGCACCACTGTCTATCCAGCTAGCGGGAGCAGCATCGACTGGG
CGTATGACAACGGCATCAAATTTGCATTCACATTTGAGTTGAGAGATACCGGGACCTATGGC
TTCCTCCTGCCAGCTAACCAGATCATCCCCACTGCAGAGGAGACGTGGCTGGGGCTGAAGAC
CATCATGGAGCATGTGCGGGACAACCTCTACTAGGCGATGGCTCTGCTCTGTCTACATTTAT
TTGTACCCACACGTGCACGCACTGAGGCCATTGTTAAAGGAGCTCTTTCCTACCTGTGTGAG
TCAGAGCCCTCTGGGTTTGTGGAGCACACAGGCCTGCCCCTCTCCAGCCAGCTCCCTGGAGT
CGTGTGTCCTGGCGGTGTCCCTGCAAGAACTGGTTCTGCCAGCCTGCTCAATTTTGGTCCTG
CTGTTTTTGATGAGCCTTTTGTCTGTTTCTCCTTCCACCCTGCTGGCTGGGCGGCTGCACTC
AGCATCACCCCTTCCTGGGTGGCATGTCTCTCTACCTCATTTTAGAACCAAAGAACATC
TGAGATGATTCTCTACCCTCATCCACATCTAGCCAAGCCAGTGACCTTGCTCTGGTGGCACT
GTGGGAGACACCACTTGTCTTTAGGTGGGTCTCAAAGATGATGTAGAATTTCCTTTAATTTC
TCGCAGTCTTCCTGGAAAATATTTTCCTTTGAGCAGCAAATCTTGTAGGGATATCAGTGAAG
GTCTCTCCCTCCCTCCTCTCCTGTTTTTTTTTTTTGAGACAGAGTTTTGCTCTTGTTGCC
CAGGCTGGAGTGTGATGGCTCGATCTTGGCTCACCACAACCTCTGCCTCCTGGGTTCAAGCA
ATTCTCCTGCCTCAGCCTCTTGAGTAGCTTGGTTTATAGGCGCATGCCACCATGCCTGGCTA
ATTTTGTGTTTTTAGTAGAGACAGGGTTTCTCCATGTTGGTCAGGCTGGTCTCAAACTCCCA
ACCTCAGGTGATCTGCCCTCCTTGGCCTCCCAGAGTGCTGGGATTACAGGTGTGAGCCACTG
TGCCGGGCCCGTCCCTCCTTTTTAGGCCTGAATACAAAGTAGAAGATCACTTTCCTTCAC
TGTGCTGAGAATTTCTAGATACTACAGTTCTTACTCCTCTCTTCCCTTTGTTATTCAGTGTG
ACCAGGATGGCGGGAGGGGATCTGTGTCACTGTAGGTACTGTGCCCAGGAAGGCTGGGTGAA
GTGACCATCTAAATTGCAGGATGGTGAAATTATCCCCATCTGTCCTAATGGGCTTACCTCCT
CTTTGCCTTTTGAACTCACTTCAAAGATCTAGGCCTCATCTTACAGGTCCTAAATCACTCAT
CTGGCCTGGATAATCTCACTGCCCTGGCACATTCCCATTTGTGCTGTGGTGTATCCTGTGTT
TCCTTGTCCTGGTTTGTGTGTGTGTGTGTGTGTGTGTGTGTGTGTTTGTGTGTGTG
TCTGTCTATTTTGTATCCTGGACCACAAGTTCCTAAGTAGAGCAAGAATTCATCAACCAGCT
GCCTCTTGTTTCATTTCACCTCAGCACGTACCATCTGTCCTTTTGTTGTTGTTGTTTTGTTT
TTGTTTTTTTGCTTTTACCAAACATGTCTGTAAATCTTAACCTCCTGCCTAGGATTTGTACA
GCATCTGGTGTGTGCTTATAAGCCAATAAATATTCAATGTGAAAAAAAAAAAAAAAAA
```

FIGURE 134

MRWILFIGALIGSSICGQEKFFGDQVLRINVRNGDEISKLSQLVNSNNLKLNFWKSPSSFNR
PVDVLVPSVSLQAFKSFLRSQGLEYAVTIEDLQALLDNEDDEMQHNEGQERSSNNFNYGAYH
SLEAIYHEMDNIAADFPDLARRVKIGHSFENRPMYVLKFSTGKGVRRPAVWLNAGIHSREWI
SQATAIWTARKIVSDYQRDPAITSILEKMDIFLLPVANPDGYVYTQTQNRLWRKTRSRNPGS
SCIGADPNRNWNASFAGKGASDNPCSEVYHGPHANSEVEVKSVVDFIQKHGNFKGFIDLHSY
SQLLMYPYGYSVKKAPDAEELDKVARLAAKALASVSGTEYQVGPTCTTVYPASGSSIDWAYD
NGIKFAFTFELRDTGTYGFLLPANQIIPTAEETWLGLKTIMEHVRDNLY

Signal peptide:
amino acids 1-16

FIGURE 135

CAACCATGCAAGGACAGGGCAGGAGAAGAGGAACCTGCAAAGACATATTTTGTTCCAAAATG
GCATCTTACCTTTATGGAGTACTCTTTGCTGTTGGCCTCTGTGCTCCAATCTACTGTGTGTC
CCCGGCCAATGCCCCCAGTGCATACCCCGCCCTTCCTCCACAAAGAGCACCCCTGCCTCAC
AGGTGTATTCCCTCAACACCGACTTTGCCTTCCGCCTATACCGCAGGCTGGTTTTGGAGACC
CCGAGTCAGAACATCTTCTTCTCCCTGTGAGTGTCTCCACTTCCTGGCCATGCTCTCCCT
TGGGGCCCACTCAGTCACCAAGACCCAGATTCTCCAGGGCCTGGGCTTCAACCTCACACACA
CACCAGAGTCTGCCATCCACCAGGGCTTCCAGCACCTGGTTCACTCACTGACTGTTCCCAGC
AAAGACCTGACCTTGAAGATGGGAAGTGCCCTCTTCGTCAAGAAGGAGCTGCAGCTGCAGGC
AAATTTCTTGGGCAATGTCAAGAGGCTGTATGAAGCAGAAGTCTTTTCTACAGATTTCTCCA
ACCCCTCCATTGCCCAGGCGAGGATCAACAGCCATGTGAAAAAGAAGACCCAAGGGAAGGTT
GTAGACATAATCCAAGGCCTTGACCTTCTGACGGCCATGGTTCTGGTGAATCACATTTTCTT
TAAAGCCAAGTGGGAGAAGCCCTTTCACCTTGAATATACAAGAAAGAACTTCCCATTCCTGG
TGGGCGAGCAGGTCACTGTGCAAGTCCCCATGATGCACCAGAAAGAGCAGTTCGCTTTTGGG
GTGGATACAGAGCTGAACTGCTTTGTGCTGCAGATGGATTACAAGGGAGATGCCGTGGCCTT
CTTTGTCCTCCCTAGCAAGGGCAAGATGAGGCAACTGGAACAGGCCTTGTCAGCCAGAACAC
TGATAAAGTGGAGCCACTCACTCCAGAAAAGGTGGATAGAGGTGTTCATCCCCAGATTTTCC
ATTTCTGCCTCCTACAATCTGGAAACCATCCTCCCGAAGATGGGCATCCAAAATGCCTTTGA
CAAAAATGCTGATTTTTCTGGAATTGCAAAGAGAGACTCCCTGCAGGTTTCTAAAGCAACCC
ACAAGGCTGTGCTGGATGTCAGTGAAGAGGGCACTGAGGCCACAGCAGCTACCACCACCAAG
TTCATAGTCCGATCGAAGGATGGTCCCTCTTACTTCACTGTCTCCTTCAATAGGACCTTCCT
GATGATGATTACAAATAAAGCCACAGACGGTATTCTCTTTCTAGGGAAAGTGGAAAATCCCA
CTAAATCCTAGGTGGGAAATGGCCTGTTAACTGATGGCACATTGCTAATGCACAAGAAATAA
CAAACCACATCCCTCTTTCTGTTCTGAGGGTGCATTTGACCCCAGTGGAGCTGGATTCGCTG
GCAGGGATGCCACTTCCAAGGCTCAATCACCAAACCATCAACAGGGACCCCAGTCACAAGCC
AACACCCATTAACCCCAGTCAGTGCCCTTTTCCACAAATTCTCCCAGGTAACTAGCTTCATG
GGATGTTGCTGGGTTACCATATTTCCATTCCTTGGGGCTCCCAGGAATGGAAATACGCCAAC
CCAGGTTAGGCACCTCTATTGCAGAATTACAATAACACATTCAATAAAACTAAAATATGAAT
TCAAAAAAAAAAAAAAAAAAAAAAAAAAAAAAAAAAAAAAAAAAAAAAAAAAAAAAAAAAAA
AAAAAAA

FIGURE 136

MASYLYGVLFAVGLCAPIYCVSPANAPSAYPRPSSTKSTPASQVYSLNTDFAFRLYRRLVLE
TPSQNIFFSPVSVSTSLAMLSLGAHSVTKTQILQGLGFNLTHTPESAIHQGFQHLVHSLTVP
SKDLTLKMGSALFVKKELQLQANFLGNVKRLYEAEVFSTDFSNPSIAQARINSHVKKKTQGK
VVDIIQGLDLLTAMVLVNHIFFKAKWEKPFHLEYTRKNFPFLVGEQVTVQVPMMHQKEQFAF
GVDTELNCFVLQMDYKGDAVAFFVLPSKGKMRQLEQALSARTLIKWSHSLQKRWIEVFIPRF
SISASYNLETILPKMGIQNAFDKNADFSGIAKRDSLQVSKATHKAVLDVSEEGTEATAATTT
KFIVRSKDGPSYFTVSFNRTFLMMITNKATDGILFLGKVENPTKS

Signal peptide:
amino acids 1-20

FIGURE 137

```
GGCTGACCGTGCTACATTGCCTGGAGGAAGCCTAAGGAACCCAGGCATCCAGCTGCCCACGC
CTGAGTCCAAGATTCTTCCCAGGAACACAAACGTAGGAGACCCACGCTCCTGGAAGCACCAG
CCTTTATCTCTTCACCTTCAAGTCCCCTTTCTCAAGAATCCTCTGTTCTTTGCCCTCTAAAG
TCTTGGTACATCTAGGACCCAGGCATCTTGCTTTCCAGCCACAAAGAGACAGATGAAGATGC
AGAAAGGAAATGTTCTCCTTATGTTTGGTCTACTATTGCATTTAGAAGCTGCAACAAATTCC
AATGAGACTAGCACCTCTGCCAACACTGGATCCAGTGTGATCTCCAGTGGAGCCAGCACAGC
CACCAACTCTGGGTCCAGTGTGACCTCCAGTGGGGTCAGCACAGCCACCATCTCAGGGTCCA
GCGTGACCTCCAATGGGGTCAGCATAGTCACCAACTCTGAGTTCCATACAACCTCCAGTGGG
ATCAGCACAGCCACCAACTCTGAGTTCAGCACAGCGTCCAGTGGGATCAGCATAGCCACCAA
CTCTGAGTCCAGCACAACCTCCAGTGGGGCCAGCACAGCCACCAACTCTGAGTCCAGCACAC
CCTCCAGTGGGGCCAGCACAGTCACCAACTCTGGGTCCAGTGTGACCTCCAGTGGAGCCAGC
ACTGCCACCAACTCTGAGTCCAGCACAGTGTCCAGTAGGGCCAGCACTGCCACCAACTCTGA
GTCTAGCACACTCTCCAGTGGGGCCAGCACAGCCACCAACTCTGACTCCAGCACAACCTCCA
GTGGGGCTAGCACAGCCACCAACTCTGAGTCCAGCACAACCTCCAGTGGGGCCAGCACAGCC
ACCAACTCTGAGTCCAGCACAGTGTCCAGTAGGGCCAGCACTGCCACCAACTCTGAGTCCAG
CACAACCTCCAGTGGGGCCAGCACAGCCACCAACTCTGAGTCCAGAACGACCTCCAATGGGG
CTGGCACAGCCACCAACTCTGAGTCCAGCACGACCTCCAGTGGGGCCAGCACAGCCACCAAC
TCTGACTCCAGCACAGTGTCCAGTGGGGCCAGCACTGCCACCAACTCTGAGTCCAGCACGAC
CTCCAGTGGGGCCAGCACAGCCACCAACTCTGAGTCCAGCACGACCTCCAGTGGGGCTAGCA
CAGCCACCAACTCTGACTCCAGCACAACCTCCAGTGGGGCCGGCACAGCCACCAACTCTGAG
TCCAGCACAGTGTCCAGTGGGATCAGCACAGTCACCAATTCTGAGTCCAGCACACCCTCCAG
TGGGGCCAACACAGCCACCAACTCTGAGTCCAGTACGACCTCCAGTGGGGCCAACACAGCCA
CCAACTCTGAGTCCAGCACAGTGTCCAGTGGGGCCAGCACTGCCACCAACTCTGAGTCCAGC
ACAACCTCCAGTGGGGTCAGCACAGCCACCAACTCTGAGTCCAGCACAACCTCCAGTGGGGC
TAGCACAGCCACCAACTCTGACTCCAGCACAACCTCCAGTGAGGCCAGCACAGCCACCAACT
CTGAGTCTAGCACAGTGTCCAGTGGGATCAGCACAGTCACCAATTCTGAGTCCAGCACAACC
TCCAGTGGGGCCAACACAGCCACCAACTCTGGGTCCAGTGTGACCTCTGCAGGCTCTGGAAC
AGCAGCTCTGACTGGAATGCACACAACTTCCCATAGTGCATCTACTGCAGTGAGTGAGGCAA
AGCCTGGTGGGTCCCTGGTGCCGTGGGAAATCTTCCTCATCACCCTGGTCTCGGTTGTGGCG
GCCGTGGGGCTCTTTGCTGGGCTCTTCTTCTGTGTGAGAAACAGCCTGTCCCTGAGAAACAC
CTTTAACACAGCTGTCTACCACCCTCATGGCCTCAACCATGGCCTTGGTCCAGGCCCTGGAG
GGAATCATGGAGCCCCCCACAGGCCCAGGTGGAGTCCTAACTGGTTCTGGAGGAGACCAGTA
TCATCGATAGCCATGGAGATGAGCGGGAGGAACAGCGGGCCCTGAGCAGCCCCGGAAGCAAG
TGCCGCATTCTTCAGGAAGGAAGAGACCTGGGCACCCAAGACCTGGTTTCCTTTCATTCATC
CCAGGAGACCCCTCCCAGCTTTGTTTGAGATCCTGAAAATCTTGAAGAAGGTATTCCTCACC
TTTCTTGCCTTTACCAGACACTGGAAAGAGAATACTATATTGCTCATTTAGCTAAGAAATAA
ATACATCTCATCTAACACACACGACAAAGAGAAGCTGTGCTTGCCCCGGGGTGGGTATCTAG
CTCTGAGATGAACTCAGTTATAGGAGAAAACCTCCATGCTGGACTCCATCTGGCATTCAAAA
TCTCCACAGTAAAATCCAAAGACCTCAAAAAAAAAAAAAAAAAAAAAAAAAAAAAAAAAAAA
AAAAAAAAAAAAAAAAAA
```

FIGURE 138

MKMQKGNVLLMFGLLLHLEAATNSNETSTSANTGSSVISSGASTATNSGSSVTSSGVSTATI
SGSSVTSNGVSIVTNSEFHTTSSGISTATNSEFSTASSGISIATNSESSTTSSGASTATNSE
SSTPSSGASTVTNSGSSVTSSGASTATNSESSTVSSRASTATNSESSTLSSGASTATNSDSS
TTSSGASTATNSESSTTSSGASTATNSESSTVSSRASTATNSESSTTSSGASTATNSESRTT
SNGAGTATNSESSTTSSGASTATNSDSSTVSSGASTATNSESSTTSSGASTATNSESSTTSS
GASTATNSDSSTTSSGAGTATNSESSTVSSGISTVTNSESSTPSSGANTATNSESSTTSSGA
NTATNSESSTVSSGASTATNSESSTTSSGVSTATNSESSTTSSGASTATNSDSSTTSSEAST
ATNSESSTVSSGISTVTNSESSTTSSGANTATNSGSSVTSAGSGTAALTGMHTTSHSASTAV
SEAKPGGSLVPWEIFLITLVSVVAAVGLFAGLFFCVRNSLSLRNTFNTAVYHPHGLNHGLGP
GPGGNHGAPHRPRWSPNWFWRRPVSSIAMEMSGRNSGP

Signal peptide:

amino acids 1-20

Transmembrane domain:

amino acids 510-532

FIGURE 139

GGGAGAGAGGATAAATAGCAGCGTGGCTTCCCTGGCTCCTCTCTGCATCCTTCCCGACCTTC
CCAGCAATATGCATCTTGCACGTCTGGTCGGCTCCTGCTCCCTCCTTCTGCTACTGGGGGCC
CTGTCTGGATGGGCGGCCAGCGATGACCCCATTGAGAAGGTCATTGAAGGGATCAACCGAGG
GCTGAGCAATGCAGAGAGAGAGGTGGGCAAGGCCCTGGATGGCATCAACAGTGGAATCACGC
ATGCCGGAAGGGAAGTGGAGAAGGTTTTCAACGGACTTAGCAACATGGGGAGCCACACCGGC
AAGGAGTTGGACAAAGGCGTCCAGGGGCTCAACCACGGCATGGACAAGGTTGCCCATGAGAT
CAACCATGGTATTGGACAAGCAGGAAAGGAAGCAGAGAAGCTTGGCCATGGGGTCAACAACG
CTGCTGGACAGGCCGGGAAGGAAGCAGACAAAGCGGTCCAAGGGTTCCACACTGGGGTCCAC
CAGGCTGGGAAGGAAGCAGAGAAACTTGGCCAAGGGGTCAACCATGCTGCTGACCAGGCTGG
AAAGGAAGTGGAGAAGCTTGGCCAAGGTGCCCACCATGCTGCTGGCCAGGCCGGGAAGGAGC
TGCAGAATGCTCATAATGGGGTCAACCAAGCCAGCAAGGAGGCCAACCAGCTGCTGAATGGC
AACCATCAAAGCGGATCTTCCAGCCATCAAGGAGGGGCCACAACCACGCCGTTAGCCTCTGG
GGCCTCAGTCAACACGCCTTTCATCAACCTTCCCGCCCTGTGGAGGAGCGTCGCCAACATCA
TGCCCTAACTGGCATCCGGCCTTGCTGGGAGAATAATGTCGCCGTTGTCACATCAGCTGAC
ATGACCTGGAGGGGTTGGGGGTGGGGGACAGGTTTCTGAAATCCCTGAAGGGGGTTGTACTG
GGATTTGTGAATAAACTTGATACACCA

FIGURE 140

></usr/seqdb2/sst/DNA/Dnaseqs.min/ss.DNA66675
><subunit 1 of 1, 247 aa, 1 stop
><MW: 25335, pI: 7.00, NX(S/T): 0
MHLARLVGSCSLLLLLGALSGWAASDDPIEKVIEGINRGLSNAEREVGKALDGINSGITHAG
REVEKVFNGLSNMGSHTGKELDKGVQGLNHGMDKVAHEINHGIGQAGKEAEKLGHGVNNAAG
QAGKEADKAVQGFHTGVHQAGKEAEKLGQGVNHAADQAGKEVEKLGQGAHHAAGQAGKELQN
AHNGVNQASKEANQLLNGNHQSGSSSHQGGATTTPLASGASVNTPFINLPALWRSVANIMP

Important features of the protein:

Signal peptide:

amino acids 1-25

Homologous region to circumsporozoite (CS) repeats:

amino acids 35-225

FIGURE 141

```
CTCCGGGTCCCCAGGGGCTGCGCCGGGCCGGCCTGGCAAGGGGGACGAGTCAGTGGACACTCCAGGAAGAGCGGC
CCCGCGGGGGGCGATGACCGTGCGCTGACCCTGACTCACTCCAGGTCCGGAGGCGGGGGCCCCCGGGGCGACTCG
GGGGCGGACCGCGGGGCGGAGCTGCCGCCCGTGAGTCCGGCCGAGCCACCTGAGCCCGAGCCGCGGGACACCGTC
GCTCCTGCTCTCCGAATGCTGCGCACCGCGATGGGCCTGAGGAGCTGGCTCGCCGCCCCATGGGGCGCGCTGCCG
CCTCGGCCACCGCTGCTGCTGCTCCTGCTGCTGCTGCTCCTGCTGCAGCCGCCGCCTCCGACCTGGGCGCTCAGC
CCCCGGATCAGCCTGCCTCTGGGCTCTGAAGAGCGGCCATTCCTCAGATTCGAAGCTGAACACATCTCCAACTAC
ACAGCCCTTCTGCTGAGCAGGGATGGCAGGACCCTGTACGTGGGTGCTCGAGAGGCCCTCTTTGCACTCAGTAGC
AACCTCAGCTTCCTGCCAGGCGGGGAGTACCAGGAGCTGCTTTGGGGTGCAGACGCAGAGAAGAAACAGCAGTGC
AGCTTCAAGGGCAAGGACCCACAGCGCGACTGTCAAAACTACATCAAGATCCTCCTGCCGCTCAGCGGCAGTCAC
CTGTTCACCTGTGGCACAGCAGCCTTCAGCCCCATGTGTACCTACATCAACATGGAGAACTTCACCCTGGCAAGG
GACGAGAAGGGGAATGTCCTCCTGGAAGATGGCAAGGGCCGTTGTCCCTTCGACCCGAATTTCAAGTCCACTGCC
CTGGTGGTTGATGGCGAGCTCTACACTGGAACAGTCAGCAGCTTCCAAGGGAATGACCCGGCCATCTCGCGGAGC
CAAAGCCTTCGCCCCACCAAGACCGAGAGCTCCCTCAACTGGCTGCAAGACCCAGCTTTTGTGGCCTCAGCCTAC
ATTCCTGAGAGCCTGGGCAGCTTGCAAGGCGATGATGACAAGATCTACTTTTTCTTCAGCGAGACTGGCCAGGAA
TTTGAGTTCTTTGAGAACACCATTGTGTCCCGCATTGCCCGCATCTGCAAGGGCGATGAGGGTGGAGAGCGGGTG
CTACAGCAGCGCTGGACCTCCTTCCTCAAGGCCTGACGCTGCTGTGCTCACGGCCCGACGATGGCTTCCCCTTCAAC
GTGCTGCAGGATGTCTTCACGCTGAGCCCCAGCCCCCAGGACTGGCGTGACACCCTTTTCTATGGGTCTTCACT
TCCCAGTGGCACAGGGGAACTACAGAAGGCTCTGCCGTCTGTGTCTTCACAATGAAGGATGTGCAGAGAGTCTTC
AGCGGCCTCTACAAGGAGGTGAACCGTGAGACACAGCAGTGGTACACCGTGACCCACCCGGTGCCCACACCCCGG
CCTGGAGCGTGCATCACCAACAGTGCCCGGGAAAGGAAGATCAACTCATCCCTGCAGCTCCCAGACCGCGTGCTG
AACTTCCTCAAGGACCACTTCCTGATGGACGGGCAGGTCCGAAGCCGCATGCTGCTGCTGCAGCCCCAGGCTCGC
TACCAGCGCGTGGCTGTACACCGCGTCCCTGGCCTGCACCACACCTACGATGTCCTCTTCCTGGGCACTGGTGAC
GGCCGGCTCCACAAGGCAGTGAGCGTGGGCCCCGGGTGCACATCATTGAGGAGCTGCAGATCTTCTCATCGGGA
CAGCCCGTGCAGAATCTGCTCCTGGACACCCACCAGGGGCTGCTGTATGCGGCCTCACACTCGGGCGTAGTCCAG
GTGCCCATGGCCAACTGCAGCCTGTACCGGAGCTGTGGGGACTGCCTCCTCGCCCGGGACCCCTACTGTGCTTGG
AGCGGCTCCAGCTGCAAGCACGTCAGCCTCTACCAGCCTCAGCTGGCCACCAGGCCGTGGATCCAGGACATCGAG
GGAGCCAGCGCCAAGGACCTTTGCAGCGCGTCTTCGGTTGTGTCCCCGTCTTTTGTACCAACAGGGGAGAAGCCA
TGTGAGCAAGTCCAGTTCCAGCCCAACACAGTGAACACTTTGGCCTGCCCGCTCCTCTCCAACCTGGCGACCCGA
CTCTGGCTACGCAACGGGGCCCCCGTCAATGCCTCGGCCTCCTGCCACGTGCTACCCACTGGGGACCTGCTGCTG
GTGGGCACCCAACAGCTGGGGGAGTTCCAGTGCTGGTCACTAGAGGAGGGCTTCCAGCAGCTGGTAGCCAGCTAC
TGCCCAGAGGTGGTGGAGGACGGGGTGGCAGACCAAACAGATGAGGGTGGCAGTGTACCCGTCATTATCAGCACA
TCGCGTGTGAGTGCACCAGCTGGTGGCAAGGCCAGCTGGGGTGCAGACAGGTCCTACTGGAAGGAGTTCCTGGTG
ATGTGCACGCTCTTTGTGCTGGCCGTGCTGCTCCCAGTTTTATTCTTGCTCTACCGGCACCGGAACAGCATGAAA
GTCTTCCTGAAGCAGGGGGAATGTGCCAGCGTGCCACCCCAAGACCTGCCCTGTGGTGCTGCCCCCCTGAGACCCGC
CCACTCAACGGCCTAGGGCCCCCTAGCACCCCGCTCGATCACCGAGGGTACCAGTCCCTGTCAGACAGCCCCCCG
GGGGCCCGAGTCTTCACTGAGTCAGAGAAGAGGCCACTCAGCATCCAAGACAGCTTCGTGGAGGTATCCCCAGTG
TGCCCCGGCCCCGGGTCCGCCTTGGCTCGGAGATCCGTGACTCTGTGGTGAGAGCTGACTTCCAGAGGACGC
TGCCCTGGCTTCAGGGGCTGTGAATGCTCGGAGAGGGTCAACTGGACCTCCCCTCCGCTCTGCTCTTCGTGGAAC
ACGACCGTGGTGCCCGGCCCTTGGGAGCCTTGGAGCCAGCTGGCCTGCTGCTCTCCAGTCAAGTAGCGAAGCTCC
TACCACCCAGACACCCAAACAGCCGTGGCCCCAGAGGTCCTGGCCAAATATGGGGCCTGCCTAGGTTGGTGGAA
CAGTGCTCCTTATGTAAACTGAGCCCTTTGTTTAAAAAACAATTCCAAATGTGAAACTAGAATGAGAGGGAAGAG
ATAGCATGGCATGCAGCACACACGGCTGCTCCAGTTCATGGCCTCCCAGGGGTGCTGGGGATGCATCCAAAGTGG
TTGTCTGAGACAGAGTTGGAAACCCTCACCAACTGGCCTCTTCACCTTCCACATTATCCCGCTGCCACCGGCTGC
CCTGTCTCACTGCAGATTCAGGACCAGCTTGGGCTGCGTGCGTTCTGCCTTGCCAGTCAGCCGAGGATGTAGTTG
TTGCTGCCGTCGTCCCACCACCTCAGGGACCAGAGGGCTAGGTTGGCACTGCGGCCCTCACCAGGTCCTGGGCTC
GGACCCAACTCCTGGACCTTTCCAGCCTGTATCAGGCTGTGGCCACACGAGAGGACAGCGCGAGCTCAGGAGAGA
TTTCGTGACAATGTACGCCTTTCCCTCAGAATTCAGGGAAGAGACTGTCGCCTGCCTTCCTCCGTTGTTGCGTGA
GAACCCGTGTGCCCCTTCCCACCATATCCACCCTGCTCCATCTTTGAACTCAAACACGAGGAACTAACTGCACC
CTGGTCCTCTCCCCAGTCCCCAGTTCACCCTCCATCCCTCACCTTCCTCCACTCTAAGGGATATCAACACTGCCC
AGCACAGGGGCCCTGAATTTATGTGGTTTTTATACATTTTTAATAAGATGCACTTTATGTCATTTTTTAATAAA
GTCTGAAGAATTACTGTTTAAAAAAAAAAAA
```

FIGURE 142

```
></usr/seqdb2/sst/DNA/Dnaseqs.min/ss.DNA67962
><subunit 1 of 1, 837 aa, 1 stop
><MW: 92750, pI: 7.04, NX(S/T): 6
MLRTAMGLRSWLAAPWGALPPRPPLLLLLLLLLLQPPPPTWALSPRISLPLGSEERPFLRF
EAEHISNYTALLLSRDGRTLYVGAREALFALSSNLSFLPGGEYQELLWGADAEKKQQCSFKG
KDPQRDCQNYIKILLPLSGSHLFTCGTAAFSPMCTYINMENFTLARDEKGNVLLEDGKGRCP
FDPNFKSTALVVDGELYTGTVSSFQGNDPAISRSQSLRPTKTESSLNWLQDPAFVASAYIPE
SLGSLQGDDDKIYFFFSETGQEFEFFENTIVSRIARICKGDEGGERVLQQRWTSFLKAQLLC
SRPDDGFPFNVLQDVFTLSPSPQDWRDTLFYGVFTSQWHRGTTEGSAVCVFTMKDVQRVFSG
LYKEVNRETQQWYTVTHPVPTPRPGACITNSARERKINSSLQLPDRVLNFLKDHFLMDGQVR
SRMLLLQPQARYQRVAVHRVPGLHHTYDVLFLGTGDGRLHKAVSVGPRVHIIEELQIFSSGQ
PVQNLLLDTHRGLLYAASHSGVVQVPMANCSLYRSCGDCLLARDPYCAWSGSSCKHVSLYQP
QLATRPWIQDIEGASAKDLCSASSVVSPSFVPTGEKPCEQVQFQPNTVNTLACPLLSNLATR
LWLRNGAPVNASASCHVLPTGDLLLVGTQQLGEFQCWSLEEGFQQLVASYCPEVVEDGVADQ
TDEGGSVPVIISTSRVSAPAGGKASWGADRSYWKEFLVMCTLFVLAVLLPVLFLLYRHRNSM
KVFLKQGECASVHPKTCPVVLPPETRPLNGLGPPSTPLDHRGYQSLSDSPPGARVFTESEKR
PLSIQDSFVEVSPVCPRPRVRLGSEIRDSVV
```

Transmembrane domains:

amino acids 23-46 (type II), 718-738

FIGURE 143A

```
CTAAGCCGGAGGATGTGCAGCTGCGGCGGCGGCGCCGGCTACGAAGAGGACGGGGACAGGCGCCGTGCGAACCGA
GCCCAGCCAGCCGGAGGACGCGGGCAGGGCGGGACGGGAGCCCGGACTCGTCTGCCGCCGCCGTCGTCGCCGTCG
TGCCGGCCCCGCGTCCCCGCGCGCGAGCGGGAGGAGCCGCCGCCACCTCGCGCCCGAGCCGCCGCTAGCGCGCGC
CGGGCATGGTCCCCTCTTAAAGGCGCAGGCCGCGGCGGCGGGGCGGGTGTGCGGAACAAAGCGCCGGCGCGGGG
CCTGCGGGCGGCTCGGGGGCCGCGATGGGCGCGGCGGGCCCGCGGCGGCGGCGGCGCTGCCCGGGCCGGGCCTCG
CGGCGCTAGGGCGGGCTGGCCTCCGTGGGCGGGGGCAGCGGGCTGAGGGCGCGCGGAGCCTGCGGCGGCGGCGGC
GGCGGCGGCGGCGGCCCGGCGGGCGGAGCGGCGCGGGCATGGCCGCGCGCGGCCGGCGCGCCTGGCTCAGCGTGC
TGCTCGGGCTCGTCCTGGGCTTCGTGCTGGCCTCGCGGCTCGTCCTGCCCCGGGCTTCCGAGCTGAAGCGAGCGG
GCCCACGGCGCCGCGCCAGCCCCGAGGGCTGCCGGTCCGGGCAGGCGGCGGCTTCCCAGGCCGGCGGGGCGCGCG
GCGATGCGCGCGGGGCGCAGCTCTGGCCGCCCGGCTCGGACCCAGATGGCGGCCCGCGCGACAGGAACTTTCTCT
TCGTGGGAGTCATGACCGCCCAGAAATACCTGCAGACTCGGGCCGTGGCCGCCTACAGAACATGGTCCAAGACAA
TTCCTGGGAAAGTTCAGTTCTTCTCAAGTGAGGGTTCTGACACATCTGTACCAATTCCAGTAGTGCCACTACGGG
GTGTGGACGACTCCTACCCGCCCCAGAAGAAGTCCTTCATGATGCTCAAGTACATGCACGACCACTACTTGGACA
AGTATGAATGGTTTATGAGAGCAGATGATGACGTGTACATCAAAGGAGACCGTCTGGAGAACTTCCTGAGGAGTT
TGAACAGCAGCGAGCCCCTCTTTCTTGGGCAGACAGGCCTGGGCACCACGGAAGAAATGGGAAAACTGGCCCTGG
AGCCTGGTGAGAACTTCTGCATGGGGGGGCCTGGCGTGATCATGAGCCGGGAGGTGCTTCGGAGAATGGTGCCGC
ACATTGGCAAGTGTCTCCGGGAGATGTACACCACCCATGAGGACGTGGAGGTGGGAAGGTGTGTCCGGAGGTTTG
CAGGGGTGCAGTGTGTCTGGTCTTATGAGATGCGGCAGCTTTTTTATGAGAATTACGAGCAGAACAAAAAGGGGT
ACATTAGAGATCTCCATAACAGTAAAATTCACCAAGCTATCACATTACACCCCAACAAAAACCCACCCTACCAGT
ACAGGCTCCACAGCTACATGCTGAGCCGCAAGATATCCGAGCTCCGCCATCGCACAATACAGCTGCACCGCGAAA
TTGTCCTGATGAGCAAATACAGCAACACAGAAATTCATAAAGAGGACCTCCAGCTGGGAATCCCTCCCTCCTTCA
TGAGGTTTCAGCCCCGCCAGCGAGAGGAGATTCTGGAATGGGAGTTTCTGACTGGAAAATACTTGTATTCGGCAG
TTGACGGCCAGCCCCCTCGAAGAGGAATGGACTCCGCCCAGAGGGAAGCCTTGGACGACATTGTCATGCAGGTCA
TGGAGATGATCAATGCCAACGCCAAGACCAGAGGGCGCATCATTGACTTCAAAGAGATCCAGTACGGCTACCGCC
GGGTGAACCCCATGTATGGGCTGAGTACATCCTGGACCTGCTGCTTCTGTACAAAAGCACAAAGGGAAGAAAA
TGACGGTCCCTGTGAGGAGGCACGCGTATTTACAGCAGACTTTCAGCAAAATCCAGTTTGTGGAGCATGAGGAGC
TGGATGCACAAGAGTTGGCCAAGAGAATCAATCAGGAATCTGGATCCTTGTCCTTTCTCTCAAACTCCCTGAAGA
AGCTCGTCCCCTTTCAGCTCCCTGGGTCGAAGAGTGAGCACAAAGAACCCAAAGATAAAAAGATAAACATACTGA
TTCCTTTGTCTGGGCGTTTCGACATGTTTGTGAGATTTATGGGAAACTTTGAGAAGACGTGTCTTATCCCCAATC
AGAACGTCAAGCTCGTGGTTCTGCTTTTCAATTCTGACTCCAACCCTGACAAGGCCAAACAAGTTGAACTGATGA
GAGATTACCGCATTAAGTACCCTAAAGCCGACATGCAGATTTTGCCTGTGTCTGGAGAGTTTTCAAGAGCCCTGG
CCCTGGAAGTAGGATCCTCCCAGTTTAACAATGAATCTTTGCTCTTCTTCTGCGACGTCGACCTCGTGTTTACTA
CAGAATTCCTTCAGCGATGTCGAGCAAATACAGTTCTGGGCCAACAAATATATTTTCCAATCATCTTCAGCCAGT
ATGACCCAAAGATTGTTTATAGTGGGAAAGTTCCCAGTGACAACCATTTTGCCTTTACTCAGAAAACTGGCTTCT
GGAGAAACTATGGGTTTGGCATCACGTGTATTTATAAGGGAGATCTTGTCCGAGTGGGTGGCTTTGATGTTTCCA
TCCAAGGCTGGGGGCTGGAGGATGTGGACCTTTTCAACAAGGTTGTCCAGGCAGGTTTGAAGACGTTTAGGAGCC
AGGAAGTAGGAGTAGTCCACGTCCACCATCCTGTCTTTTGTGATCCCAATCTTGACCCCAAACAGTACAAAATGT
GCTTGGGGTCCAAAGCATCGACCTATGGGTCCACCCAGCAGCTGGCTGAGATGTGGCTGGAAAAAAATGATCCAA
GTTACAGTAAAAGCAGCAATAATAATGGCTCAGTGAGGACAGCCTAATGTCCAGCTTTGCTGGAAAAGACGTTTT
TAATTATCTAATTTATTTTTCAAAAATTTTTTGTATGATCAGTTTTTGAAGTCCGTATACAAGGATATATTTTAC
AAGTGGTTTTCTTACATAGGACTCCTTTAAGATTGAGCTTTCTGAACAAGAAGGTGATCAGTGTTTGCCTTTGAA
CACATCTTCTTGCTGAACATTATGTAGCAGACCTGCTTAACTTTGACTTGAAATGTACCTGATGAACAAAACTTT
TTTAAAAAAATGTTTTCTTTTGAGACCCTTTGCTCCAGTCCTATGGCAGAAAACGTGAACATTCCTGCAAAGTAT
TATTGTAACAAAACACTGTAACTCTGGTAAATGTTCTGTTGTGATTGTTAACATTCCACAGATTCTACCTTTTGT
GTTTTGTTTTTTTTTTTACAATTGTTTTAAAGCCATTTCATGTTCCAGTTGTAAGATAAGGAAATGTGATAATA
GCTGTTTCATCATTGTCTTCAGGAGAGCTTTCCAGAGTTGATCATTTCCTCTCATGGTACTCTGCTCAGCATGGC
CACGTAGGTTTTTTGTTTGTTTTGTTTTGTTCTTTTTTGAGACGGAGTCTCACTCTGTTACCCAGGCTGGAATG
CAGTGGCGCAATCTTGGCTCACTTTAACCTCCACTTCCCTGGTTCAAGCAATTCCCCTGCCTTTGCCTCCCGAGT
AGCTGGGATTACAGGCACACACCACCACGCCCAGNTAGTTTTTTGTATTTTTAGTAGAGACGGGGTTTCACCAT
GCAAGCCCAGCTGGCCACGTAGGTTTTAAAGCAAGGGGCGTGAAGAAGGCACAGTGAGGTATGTGGCTGTTCTCG
TGGTAGTTCATTCGGCCTAAATAGACCTGGCATTAAATTTCAAGAAGGATTTGGCATTTTCTCTTCTTGACCCTT
CTCTTTAAAGGGTAAAATATTAATGTTTAGAATGACAAAGATGAATTATTACAATAAATCTGATGTACACAGACT
GAAACATACACACATACACCCTAATCAAAACGTTGGGGAAAAATGTATTTGGTTTTGTTCCTTTCATCCTGTCTG
TGTTATGTGGGTGGAGATGGTTTTCATTCTTTCATTACTGTTTTGTTTTATCCTTTGTATCTGAAATACCTTTAA
TTTATTTAATATCTGTTGTTCAGAGCTCTGCCATTCTTGAGTACCTGTTAGTTAGTATTATTTATGTGTATCGG
GAGTGTGTTTAGTCTGTTTTATTTGCAGTAAACCGATCTCCAAAGATTTCCTTTTGGAAACGCTTTTTCCCCTCC
```

FIGURE 143B

```
TTAATTTTTATATTCCTTACTGTTTTACTAAATATTAAGTGTTCTTTGACAATTTTGGTGCTCATGTGTTTTGGG
GACAAAAGTGAAATGAATCTGTCATTATACCAGAAAGTTAAATTCTCAGATCAAATGTGCCTTAATAAATTTGTT
TTCATTTAGATTTCAAACAGTGATAGACTTGCCATTTTAATACACGTCATTGGAGGGCTGCGTATTTGTAAATAG
CCTGATGCTCATTTGGAAAAATAAACCAGTGAACAATATTTTTCTATTGTACTTTTCGAACCATTTTGTCTCATT
ATTCCTGTTTTAGCTGAAGAATTGTATTACATTTGGAGAGTAAAAAACTTAAACACGAAAAAA
```

FIGURE 144

></usr/seqdb2/sst/DNA/Dnaseqs.min/ss.DNA68836
><subunit 1 of 1, 802 aa, 1 stop
><MW: 91812, pI: 9.52, NX(S/T): 3

MAARGRRAWLSVLLGLVLGFVLASRLVLPRASELKRAGPRRRASPEGCRSGQAAASQAGGAR
GDARGAQLWPPGSDPDGGPRDRNFLFVGVMTAQKYLQTRAVAAYRTWSKTIPGKVQFFSSEG
SDTSVPIPVVPLRGVDDSYPPQKKSFMMLKYMHDHYLDKYEWFMRADDDVYIKGDRLENFLR
SLNSSEPLFLGQTGLGTTEEMGKLALEPGENFCMGGPGVIMSREVLRRMVPHIGKCLREMYT
THEDVEVGRCVRRFAGVQCVWSYEMRQLFYENYEQNKKGYIRDLHNSKIHQAITLHPNKNPP
YQYRLHSYMLSRKISELRHRTIQLHREIVLMSKYSNTEIHKEDLQLGIPPSFMRFQPRQREE
ILEWEFLTGKYLYSAVDGQPPRRGMDSAQREALDDIVMQVMEMINANAKTRGRIIDFKEIQY
GYRRVNPMYGAEYILDLLLLYKKHKGKKMTVPVRRHAYLQQTFSKIQFVEHEELDAQELAKR
INQESGSLSFLSNSLKKLVPFQLPGSKSEHKEPKDKKINILIPLSGRFDMFVRFMGNFEKTC
LIPNQNVKLVVLLFNSDSNPDKAKQVELMRDYRIKYPKADMQILPVSGEFSRALALEVGSSQ
FNNESLLFFCDVDLVFTTEFLQRCRANTVLGQQIYFPIIFSQYDPKIVYSGKVPSDNHFAFT
QKTGFWRNYGFGITCIYKGDLVRVGGFDVSIQGWGLEDVDLFNKVVQAGLKTFRSQEVGVVH
VHHPVFCDPNLDPKQYKMCLGSKASTYGSTQQLAEMWLEKNDPSYSKSSNNNGSVRTA

Signal peptide:
amino acids 1-23

FIGURE 145

```
GGACAACCGTTGCTGGGTGTCCCAGGGCCTGAGGCAGGACGGTACTCCGCTGACACCTTCCC
TTTCGGCCTTGAGGTTCCCAGCCTGGTGGCCCCAGGACGTTCCGGTCGCATGGCAGAGTGCT
ACGGACGACGCCTATGAAGCCCTTAGTCCTTCTAGTTGCGCTTTTGCTATGGCCTTCGTCTG
TGCCGGCTTATCCGAGCATAACTGTGACACCTGATGAAGAGCAAAACTTGAATCATTATATA
CAAGTTTTAGAGAACCTAGTACGAAGTGTTCCCTCTGGGGAGCCAGGTCGTGAGAAAAATC
TAACTCTCCAAAACATGTTTATTCTATAGCATCAAAGGGATCAAAATTTAAGGAGCTAGTTA
CACATGGAGACGCTTCAACTGAGAATGATGTTTTAACCAATCCTATCAGTGAAGAAACTACA
ACTTTCCCTACAGGAGGCTTCACACCGGAAATAGGAAAGAAAAAACACACGGAAAGTACCCC
ATTCTGGTCGATCAAACCAAACAATGTTTCCATTGTTTTGCATGCAGAGGAACCTTATATTG
AAAATGAAGAGCCAGAGCCAGAGCCGGAGCCAGCTGCAAAACAAACTGAGGCACCAAGAATG
TTGCCAGTTGTTACTGAATCATCTACAAGTCCATATGTTACCTCATACAAGTCACCTGTCAC
CACTTTAGATAAGAGCACTGGCATTGAGATCTCTACAGAATCAGAAGATGTTCCTCAGCTCT
CAGGTGAAACTGCGATAGAAAACCCGAAGAGTTTGGAAAGCACCCAGAGAGTTGGAATAAT
GATGACATTTTGAAAAAATTTTAGATATTAATTCACAAGTGCAACAGGCACTTCTTAGTGA
CACCAGCAACCCAGCATATAGAGAAGATATTGAAGCCTCTAAAGATCACCTAAAACGAAGCC
TTGCTCTAGCAGCAGCAGCAGAACATAAATTAAAAACAATGTATAAGTCCCAGTTATTGCCA
GTAGGACGAACAAGTAATAAAATTGATGACATCGAAACTGTTATTAACATGCTGTGTAATTC
TAGATCTAAACTCTATGAATATTTAGATATTAAATGTGTTCCACCAGAGATGAGAGAAAAG
CTGCTACAGTATTCAATACATTAAAAAATATGTGTAGATCAAGGAGAGTCACAGCCTTATTA
AAAGTTTATTAAACAATAATATAAAAATTTTAAACCTACTTGATATTCCATAACAAAGCTGA
TTTAAGCAAACTGCATTTTTTCACAGGAGAAATAATCATATTCGTAATTTCAAAAGTTGTAT
AAAAATATTTTCTATTGTAGTTCAAATGTGCCAACATCTTTATGTGTCATGTGTTATGAACA
ATTTTCATATGCACTAAAAACCTAATTTAAAATAAAATTTTGGTTCAGGAAAAAA
```

FIGURE 146

></usr/seqdb2/sst/DNA/Dnaseqs.min/ss.DNA68864
><subunit 1 of 1, 350 aa, 1 stop
><MW: 39003, pI: 5.59, NX(S/T): 1
MKPLVLLVALLLWPSSVPAYPSITVTPDEEQNLNHYIQVLENLVRSVPSGEPGREKKSNSPK
HVYSIASKGSKFKELVTHGDASTENDVLTNPISEETTTFPTGGFTPEIGKKKHTESTPFWSI
KPNNVSIVLHAEEPYIENEEPEPEPEPAAKQTEAPRMLPVVTESSTSPYVTSYKSPVTTLDK
STGIEISTESEDVPQLSGETAIEKPEEFGKHPESWNNDDILKKILDINSQVQQALLSDTSNP
AYREDIEASKDHLKRSLALAAAAEHKLKTMYKSQLLPVGRTSNKIDDIETVINMLCNSRSKL
YEYLDIKCVPPEMREKAATVFNTLKNMCRSRRVTALLKVY

Signal peptide:

amino acids 1-19

FIGURE 147

CGGCTCGAGCGGCTCGAGTGAAGAGCCTCTCCACGGCTCCTGCGCCTGAGACAGCTGGCCTG
ACCTCCAAATCATCCATCCACCCCTGCTGTCATCTGTTTTCATAGTGTGAGATCAACCCACA
GGAATATCCATGGCTTTTGTGCTCATTTTGGTTCTCAGTTTCTACGAGCTGGTGTCAGGACA
GTGGCAAGTCACTGGACCGGGCAAGTTTGTCCAGGCCTTGGTGGGGGAGGACGCCGTGTTCT
CCTGCTCCCTCTTTCCTGAGACCAGTGCAGAGGCTATGGAAGTGCGGTTCTTCAGGAATCAG
TTCCATGCTGTGGTCCACCTCTACAGAGATGGGGAAGACTGGGAATCTAAGCAGATGCCACA
GTATCGAGGGAGAACTGAGTTTGTGAAGGACTCCATTGCAGGGGGCGTGTCTCTAAGGC
TAAAAAACATCACTCCCTCGGACATCGGCCTGTATGGGTGCTGGTTCAGTTCCCAGATTTAC
GATGAGGAGGCCACCTGGGAGCTGCGGGTGGCAGCACTGGCTCACTTCCTCTCATTTCCAT
CGTGGGATATGTTGACGGAGGTATCCAGTTACTCTGCCTGTCCTCAGGCTGGTTCCCCAGC
CCACAGCCAAGTGGAAAGGTCCACAAGGACAGGATTTGTCTTCAGACTCCAGAGCAAATGCA
GATGGGTACAGCCTGTATGATGTGGAGATCTCCATTATAGTCCAGGAAAATGCTGGGAGCAT
ATTGTGTTCCATCCACCTTGCTGAGCAGAGTCATGAGGTGGAATCCAAGGTATTGATAGGAG
AGACGTTTTTCCAGCCCTCACCTTGGCGCCTGGCTTCTATTTTACTCGGGTTACTCTGTGGT
GCCCTGTGTGGTGTTGTCATGGGGATGATAATTGTTTTCTTCAAATCCAAAGGGAAAATCCA
GGCGGAACTGGACTGGAGAAGAAAGCACGGACAGGCAGAATTGAGAGACGCCCGGAAACACG
CAGTGGAGGTGACTCTGGATCCAGAGACGGCTCACCCGAAGCTCTGCGTTTCTGATCTGAAA
ACTGTAACCCATAGAAAAGCTCCCCAGGAGGTGCCTCACTCTGAGAAGAGATTTACAAGGAA
GAGTGTGGTGGCTTCTCAGGGTTTCCAAGCAGGGAGACATTACTGGGAGGTGGACGTGGGAC
AAAATGTAGGGTGGTATGTGGGAGTGTGTCGGGATGACGTAGACAGGGGGAAGAACAATGTG
ACTTTGTCTCCCAACAATGGGTATTGGGTCCTCAGACTGACAACAGAACATTTGTATTTCAC
ATTCAATCCCCATTTTATCAGCCTCCCCCCAGCACCCCTCCTACACGAGTAGGGGTCTTCC
TGGACTATGAGGGTGGGACCATCTCCTTCTTCAATACAAATGACCAGTCCCTTATTTATACC
CTGCTGACATGTCAGTTTGAAGGCTTGTTGAGACCCTATATCCAGCATGCGATGTATGACGA
GGAAAAGGGGACTCCCATATTCATATGTCCAGTGTCCTGGGGATGAGACAGAGAAGACCCTG
CTTAAAGGGCCCCACACCACAGACCCAGACACAGCCAAGGGAGAGTGCTCCCGACAGGTGGC
CCCAGCTTCCTCTCCGGAGCCTGCGCACAGAGAGTCACGCCCCCACTCTCCTTTAGGGAGC
TGAGGTTCTTCTGCCCTGAGCCCTGCAGCAGCGGCAGTCACAGCTTCCAGATGAGGGGGAT
TGGCCTGACCCTGTGGGAGTCAGAAGCCATGGCTGCCCTGAAGTGGGGACGGAATAGACTCA
CATTAGGTTTAGTTTGTGAAAACTCCATCCAGCTAAGCGATCTTGAACAAGTCACAACCTCC
CAGGCTCCTCATTTGCTAGTCACGGACAGTGATTCCTGCCTCACAGGTGAAGATTAAAGAGA
CAACGAATGTGAATCATGCTTGCAGGTTTGAGGGCACAGTGTTTGCTAATGATGTGTTTTA
TATTATACATTTTCCCACCATAAACTCTGTTTGCTTATTCCACATTAATTTACTTTTCTCTA
TACCAAATCACCCATGGAATAGTTATTGAACACCTGCTTTGTGAGGCTCAAAGAATAAAGAG
GAGGTAGGATTTTCACTGATTCTATAAGCCCAGCATTACCTGATACCAAAACCAGGCAAAG
AAAACAGAAGAAGAGGAAGGAAAACTACAGGTCCATATCCCTCATTAACACAGACACAAAAA
TTCTAAATAAAATTTTAACAAATTAAACTAAACAATATATTTAAAGATGATATATAACTACT
CAGTGTGGTTTGTCCCACAAATGCAGAGTTGGTTTAATATTTAAATATCAACCAGTGTAATT
CAGCACATTAATAAAGTAAAAAGAAAACCATAAAAAAAAAAAAAA

FIGURE 148

```
></usr/seqdb2/sst/DNA/Dnaseqs.min/ss.DNA68866
><subunit 1 of 1, 466 aa, 1 stop
><MW: 52279, pI: 6.16, NX(S/T): 2
MAFVLILVLSFYELVSGQWQVTGPGKFVQALVGEDAVFSCSLFPETSAEAMEVRFFRNQFHA
VVHLYRDGEDWESKQMPQYRGRTEFVKDSIAGGRVSLRLKNITPSDIGLYGCWFSSQIYDEE
ATWELRVAALGSLPLISIVGYVDGGIQLLCLSSGWFPQPTAKWKGPQGQDLSSDSRANADGY
SLYDVEISIIVQENAGSILCSIHLAEQSHEVESKVLIGETFFQPSPWRLASILLGLLCGALC
GVVMGMIIVFFKSKGKIQAELDWRRKHGQAELRDARKHAVEVTLDPETAHPKLCVSDLKTVT
HRKAPQEVPHSEKRFTRKSVVASQGFQAGRHYWEVDVGQNVGWYVGVCRDDVDRGKNNVTLS
PNNGYWVLRLTTEHLYFTFNPHFISLPPSTPPTRVGVFLDYEGGTISFFNTNDQSLIYTLLT
CQFEGLLRPYIQHAMYDEEKGTPIFICPVSWG
```

Signal peptide:

amino acids 1-17

Transmembrane domains:

amino acids 131-150, 235-259

FIGURE 149

CCTTCACAGGACTCTTCATTGCTGGTTGGCAATGATGTATCGGCCAGATGTGGTGAGGGCTA
GGAAAAGAGTTTGTTGGGAACCCTGGGTTATCGGCCTCGTCATCTTCATATCCCTGATTGTC
CTGGCAGTGTGCATTGGACTCACTGTTCATTATGTGAGATATAATCAAAAGAAGACCTACAA
TTACTATAGCACATTGTCATTTACAACTGACAAACTATATGCTGAGTTTGGCAGAGAGGCTT
CTAACAATTTTACAGAAATGAGCCAGAGACTTGAATCAATGGTGAAAAATGCATTTTATAAA
TCTCCATTAAGGGAAGAATTTGTCAAGTCTCAGGTTATCAAGTTCAGTCAACAGAAGCATGG
AGTGTTGGCTCATATGCTGTTGATTTGTAGATTTCACTCTACTGAGGATCCTGAAACTGTAG
ATAAAATTGTTCAACTTGTTTTACATGAAAAGCTGCAAGATGCTGTAGGACCCCCTAAAGTA
GATCCTCACTCAGTTAAAATTAAAAAAATCAACAAGACAGAAACAGACAGCTATCTAAACCA
TTGCTGCGGAACACGAAGAAGTAAAACTCTAGGTCAGAGTCTCAGGATCGTTGGTGGGACAG
·AAGTAGAAGAGGGTGAATGGCCCTGGCAGGCTAGCCTGCAGTGGGATGGGAGTCATCGCTGT
GGAGCAACCTTAATTAATGCCACATGGCTTGTGAGTGCTGCTCACTGTTTTACAACATATAA
GAACCCTGCCAGATGGACTGCTTCCTTTGGAGTAACAATAAAACCTTCGAAAATGAAACGGG
GTCTCCGGAGAATAATTGTCCATGAAAATACAAACACCCATCACATGACTATGATATTTCT
CTTGCAGAGCTTTCTAGCCCTGTTCCCTACACAAATGCAGTACATAGAGTTTGTCTCCCTGA
TGCATCCTATGAGTTTCAACCAGGTGATGTGATGTTTGTGACAGGATTTGGAGCACTGAAAA
ATGATGGTTACAGTCAAAATCATCTTCGACAAGCACAGGTGACTCTCATAGACGCTACAACT
TGCAATGAACCTCAAGCTTACAATGACGCCATAACTCCTAGAATGTTATGTGCTGGCTCCTT
AGAAGGAAAAACAGATGCATGCCAGGGTGACTCTGGAGGACCACTGGTTAGTTCAGATGCTA
GAGATATCTGGTACCTTGCTGGAATAGTGAGCTGGGGAGATGAATGTGCGAAACCCAACAAG
CCTGGTGTTTATACTAGAGTTACGGCCTTGCGGGACTGGATTACTTCAAAAACTGGTATCTA
AGAGACAAAAGCCTCATGGAACAGATAACATTTTTTTTGTTTTTGGGTGTGGAGGCCATT
TTTAGAGATACAGAATTGGAGAAGACTTGCAAAACAGCTAGATTTGACTGATCTCAATAAAC
TGTTTGCTTGATGCATGTATTTTCTTCCCAGCTCTGTTCCGCACGTAAGCATCCTGCTTCTG
CCAGATCAACTCTGTCATCTGTGAGCAATAGTTGAAACTTTATGTACATAGAGAAATAGATA
ATACAATATTACATTACAGCCTGTATTCATTTGTTCTCTAGAAGTTTTGTCAGAATTTTGAC
TTGTTGACATAAATTTGTAATGCATATATACAATTTGAAGCACTCCTTTTCTTCAGTTCCTC
AGCTCCTCTCATTTCAGCAAATATCCATTTTCAAGGTGCAGAACAAGGAGTGAAAGAAAATA
TAAGAAGAAAAAAATCCCCTACATTTTATTGGCACAGAAAAGTATTAGGTGTTTTTCTTAGT
GGAATATTAGAAATGATCATATTCATTATGAAAGGTCAAGCAAAGACAGCAGAATACCAATC
ACTTCATCATTTAGGAAGTATGGGAACTAAGTTAAGGAAGTCCAGAAAGAAGCCAAGATATA
TCCTTATTTTCATTTCCAAACAACTACTATGATAAATGTGAAGAAGATTCTGTTTTTTTGTG
ACCTATAATAATTATACAAACTTCATGCAATGTACTTGTTCTAAGCAAATTAAAGCAAATAT
TTATTTAACATTGTTACTGAGGATGTCAACATATAACAATAAAATATAAATCACCCA

FIGURE 150

```
></usr/seqdb2/sst/DNA/Dnaseqs.min/ss.DNA68871
><subunit 1 of 1, 423 aa, 1 stop
><MW: 47696, pI: 8.96, NX(S/T): 3
MMYRPDVVRARKRVCWEPWVIGLVIFISLIVLAVCIGLTVHYVRYNQKKTYNYYSTLSFTTD
KLYAEFGREASNNFTEMSQRLESMVKNAFYKSPLREEFVKSQVIKFSQQKHGVLAHMLLICR
FHSTEDPETVDKIVQLVLHEKLQDAVGPPKVDPHSVKIKKINKTETDSYLNHCCGTRRSKTL
GQSLRIVGGTEVEEGEWPWQASLQWDGSHRCGATLINATWLVSAAHCFTTYKNPARWTASFG
VTIKPSKMKRGLRRIIVHEKYKHPSHDYDISLAELSSPVPYTNAVHRVCLPDASYEFQPGDV
MFVTGFGALKNDGYSQNHLRQAQVTLIDATTCNEPQAYNDAITPRMLCAGSLEGKTDACQGD
SGGPLVSSDARDIWYLAGIVSWGDECAKPNKPGVYTRVTALRDWITSKTGI
```

Transmembrane domain:
amino acids 21-40 (type II)

FIGURE 151

GTCGAAGGTTATAAAAGCTTCCAGCCAAACGGCATTGAAGTTGAAGATACAACCTGACAGCA
CAGCCTGAGATCTTGGGGATCCCTCAGCCTAACACCCACAGACGTCAGCTGGTGGATTCCCG
CTGCATCAAGGCCTACCCACTGTCTCCATGCTGGGCTCTCCCTGCCTTCTGTGGCTCCTGGC
CGTGACCTTCTTGGTTCCCAGAGCTCAGCCCTTGGCCCCTCAAGACTTTGAAGAAGAGGAGG
CAGATGAGACTGAGACGGCGTGGCCGCCTTTGCCGGCTGTCCCTGCGACTACGACCACTGC
CGACACCTGCAGGTGCCCTGCAAGGAGCTACAGAGGGTCGGGCCGGCGGCCTGCCTGTGCCC
AGGACTCTCCAGCCCCGCCCAGCCGCCCGACCCGCCGCGCATGGGAGAAGTGCGCATTGCGG
CCGAAGAGGGCCGCGCAGTGGTCCACTGGTGTGCCCCCTTCTCCCCGGTCCTCCACTACTGG
CTGCTGCTTTGGGACGGCAGCGAGGCTGCGCAGAAGGGGCCCCCGCTGAACGCTACGGTCCG
CAGAGCCGAACTGAAGGGGCTGAAGCCAGGGGGCATTTATGTCGTTTGCGTAGTGGCCGCTA
ACGAGGCCGGGGCAAGCCGCGTGCCCCAGGCTGGAGGAGAGGGCCTCGAGGGGCCGACATC
CCTGCCTTCGGGCCTTGCAGCCGCCTTGCGGTGCCGCCCAACCCCCGCACTCTGGTCCACGC
GGCCGTCGGGGTGGGCACGGCCCTGGCCCTGCTAAGCTGTGCCGCCCTGGTGTGGCACTTCT
GCCTGCGCGATCGCTGGGGCTGCCCGCGCCGAGCCGCCGCCCGAGCCGCAGGGGCGCTCTGA
AAGGGGCCTGGGGGCATCTCGGGCACAGACAGCCCCACCTGGGGCGCTCAGCCTGGCCCCG
GGAAAGAGGAAAACCCGCTGCCTCCAGGGAGGGCTGGACGGCGAGCTGGGAGCCAGCCCCAG
GCTCCAGGGCCACGGCGGAGTCATGGTTCTCAGGACTGAGCGCTTGTTTAGGTCCGGTACTT
GGCGCTTTGTTTCCTGGCTGAGGTCTGGGAAGGAATAGAAAGGGGCCCCCAATTTTTTTTTA
AGCGGCCAGATAATAAATAATGTAACCTTTGCGGTTAAAAAAAAAAAAAAAAAA

FIGURE 152

```
></usr/seqdb2/sst/DNA/Dnaseqs.min/ss.DNA68874
><subunit 1 of 1, 238 aa, 1 stop
><MW: 25262, pI: 6.44, NX(S/T): 1
MLGSPCLLWLLAVTFLVPRAQPLAPQDFEEEEADETETAWPPLPAVPCDYDHCRHLQVPCKE
LQRVGPAACLCPGLSSPAQPPDPPRMGEVRIAAEEGRAVVHWCAPFSPVLHYWLLLWDGSEA
AQKGPPLNATVRRAELKGLKPGGIYVVCVVAANEAGASRVPQAGGEGLEGADIPAFGPCSRL
AVPPNPRTLVHAAVGVGTALALLSCAALVWHFCLRDRWGCPRRAAARAAGAL
```

Important features of the protein:

Signal peptide:

amino acids 1-20

Transmembrane domain:

amino acids 194-220

N-glycosylation site.

amino acids 132-135

FIGURE 153

```
AGAGAAAGAAGCGTCTCCAGCTGAAGCCAATGCAGCCCTCCGGCTCTCCGCGAAGAAGTTCC
CTGCCCCGATGAGCCCCGCCGTGCGTCCCGACTATCCCCAGGCGGGCGTGGGGCACCGGG
CCCAGCGCCGACGATCGCTGCCGTTTTGCCCTTGGGAGTAGGATGTGGTGAAAGGATGGGGC
TTCTCCCTTACGGGGCTCACAATGGCCAGAGAAGATTCCGTGAAGTGTCTGCGCTGCCTGCT
CTACGCCCTCAATCTGCTCTTTTGGTTAATGTCCATCAGTGTGTTGGCAGTTTCTGCTTGGA
TGAGGGACTACCTAAATAATGTTCTCACTTTAACTGCAGAAACGAGGGTAGAGGAAGCAGTC
ATTTTGACTTACTTTCCTGTGGTCATCCGGTCATGATTGCTGTTTGCTGTTTCCTTATCAT
TGTGGGATGTTAGGATATTGTGGAACGGTGAAAAGAAATCTGTTGCTTCTTGCATGGTACT
TTGGAAGTTTGCTTGTCATTTTCTGTGTAGAACTGGCTTGTGGCGTTTGGACATATGAACAG
GAACTTATGGTTCCAGTACAATGGTCAGATATGGTCACTTTGAAAGCCAGGATGACAAATTA
TGGATTACCTAGATATCGGTGGCTTACTCATGCTTGGAATTTTTTTCAGAGAGAGTTTAAGT
GCTGTGGAGTAGTATATTTCACTGACTGGTTGGAAATGACAGAGATGGACTGGCCCCCAGAT
TCCTGCTGTGTTAGAGAATTCCCAGGATGTTCCAAACAGGCCCACCAGGAAGATCTCAGTGA
CCTTTATCAAGAGGGTTGTGGGAAGAAATGTATTCCTTTTGAGAGGAACCAAACAACTGC
AGGTGCTGAGGTTTCTGGGAATCTCCATTGGGGTGACACAAATCCTGGCCATGATTCTCACC
ATTACTCTGCTCTGGGCTCTGTATTATGATAGAAGGGAGCCTGGGACAGACCAAATGATGTC
CTTGAAGAATGACAACTCTCAGCACCTGTCATGTCCCTCAGTAGAACTGTTGAAACCAAGCC
TGTCAAGAATCTTTGAACACACATCCATGGCAAACAGCTTTAATACACACTTTGAGATGGAG
GAGTTATAAAAAGAAATGTCACAGAAGAAAACCACAAACTTGTTTTATTGGACTTGTGAATT
TTTGAGTACATACTATGTGTTTCAGAAATATGTAGAAATAAAAATGTTGCCATAAAATAACA
CCTAAGCATATACTATTCTATGCTTTAAAATGAGGATGGAAAAGTTTCATGTCATAAGTCAC
CACCTGGACAATAATTGATGCCCTTAAAATGCTGAAGACAGATGTCATACCCACTGTGTAGC
CTGTGTATGACTTTTACTGAACACAGTTATGTTTTGAGGCAGCATGGTTTGATTAGCATTTC
CGCATCCATGCAAACGAGTCACATATGGTGGGACTGGAGCCATAGTAAAGGTTGATTTACTT
CTACCAACTAGTATATAAAGTACTAATTAAATGCTAACATAGGAAGTTAGAAAATACTAATA
ACTTTTATTACTCAGCGATCTATTCTTCTGATGCTAAATAAATTATATATCAGAAACTTTC
AATATTGGTGACTACCTAAATGTGATTTTTGCTGGTTACTAAAATATTCTTACCACTTAAAA
GAGCAAGCTAACACATTGTCTTAAGCTGATCAGGGATTTTTGTATATAAGTCTGTGTTAAA
TCTGTATAATTCAGTCGATTTCAGTTCTGATAATGTTAAGAATAACCATTATGAAAAGGAAA
ATTTGTCCTGTATAGCATCATTATTTTAGCCTTTCCTGTTAATAAAGCTTTACTATTCTGT
CCTGGGCTTATATTACACATATAACTGTTATTTAAATACTTAACCACTAATTTTGAAAATTA
CCAGTGTGATACATAGGAATCATTATTCAGAATGTAGTCTGGTCTTTAGGAAGTATTAATAA
GAAAATTTGCACATAACTTAGTTGATTCAGAAAGGACTTGTATGCTGTTTTTCTCCCAAATG
AAGACTCTTTTTGACACTAAACACTTTTTAAAAAGCTTATCTTTGCCTTCTCCAAACAAGAA
GCAATAGTCTCCAAGTCAATATAAATTCTACAGAAAATAGTGTTCTTTTTCTCCAGAAAAAT
GCTTGTGAGAATCATTAAAACATGTGACAATTTAGAGATTCTTTGTTTTATTTCACTGATTA
ATATACTGTGGCAAATTACACAGATTATTAAATTTTTTACAAGAGTATAGTATATTTATTT
GAAATGGGAAAGTGCATTTTACTGTATTTGTGTATTTTGTTTATTTCTCAGAATATGGAA
AGAAAATTAAAATGTGTCAATAAATATTTTCTAGAGAGTAA
```

FIGURE 154

```
></usr/seqdb2/sst/DNA/Dnaseqs.min/ss.DNA68880
><subunit 1 of 1, 305 aa, 1 stop
><MW: 35383, pI: 5.99, NX(S/T): 0
MAREDSVKCLRCLLYALNLLFWLMSISVLAVSAWMRDYLNNVLTLTAETRVEEAVILTYFPV
VHPVMIAVCCFLIIVGMLGYCGTVKRNLLLLAWYFGSLLVIFCVELACGVWTYEQELMVPVQ
WSDMVTLKARMTNYGLPRYRWLTHAWNFFQREFKCCGVVYFTDWLEMTEMDWPPDSCCVREF
PGCSKQAHQEDLSDLYQEGCGKKMYSFLRGTKQLQVLRFLGISIGVTQILAMILTITLLWAL
YYDRREPGTDQMMSLKNDNSQHLSCPSVELLKPSLSRIFEHTSMANSFNTHFEMEEL
```

Signal peptide:

amino acids 1-33

Transmembrane domains:

amino acids 12-35, 57-86, 94-114, 226-248

FIGURE 155

GAGAGAGGCAGCAGCTTGCTCAGCGGACAAGGATGCTGGGCGTGAGGGACCAAGGCCTGCCC
TGCACTCGGGCCTCCTCCAGCCAGTGCTGACCAGGGACTTCTGACCTGCTGGCCAGCCAGGA
CCTGTGTGGGGAGGCCCTCCTGCTGCCTTGGGGTGACAATCTCAGCTCCAGGCTACAGGGAG
ACCGGGAGGATCACAGAGCCAGCATGTTACAGGATCCTGACAGTGATCAACCTCTGAACAGC
CTCGATGTCAAACCCCTGCGCAAACCCCGTATCCCCATGGAGACCTTCAGAAAGGTGGGGAT
CCCCATCATCATAGCACTACTGAGCCTGGCGAGTATCATCATTGTGGTTGTCCTCATCAAGG
TGATTCTGGATAAATACTACTTCCTCTGCGGGCAGCCTCTCCACTTCATCCCGAGGAAGCAG
CTGTGTGACGGAGAGCTGGACTGTCCCTTGGGGAGGACGAGGAGCACTGTGTCAAGAGCTT
CCCCGAAGGGCCTGCAGTGGCAGTCCGCCTCTCCAAGGACCGATCCACACTGCAGGTGCTGG
ACTCGGCCACAGGGAACTGGTTCTCTGCCTGTTTCGACAACTTCACAGAAGCTCTCGCTGAG
ACAGCCTGTAGGCAGATGGGCTACAGCAGAGCTGTGGAGATTGGCCCAGACCAGGATCTGGA
TGTTGTTGAAATCACAGAAAACAGCCAGGAGCTTCGCATGCGGAACTCAAGTGGGCCCTGTC
TCTCAGGCTCCCTGGTCTCCCTGCACTGTCTTGCCTGTGGGAAGAGCCTGAAGACCCCCGT
GTGGTGGGTGGGGAGGAGGCCTCTGTGGATTCTTGGCCTTGGCAGGTCAGCATCCAGTACGA
CAAACAGCACGTCTGTGGAGGGAGCATCCTGGACCCCACTGGGTCCTCACGGCAGCCCACT
GCTTCAGGAAACATACCGATGTGTTCAACTGGAAGGTGCGGGCAGGCTCAGACAAACTGGGC
AGCTTCCCATCCCTGGCTGTGGCCAAGATCATCATCATTGAATTCAACCCCATGTACCCCAA
AGACAATGACATCGCCCTCATGAAGCTGCAGTTCCCACTCACTTTCTCAGGCACAGTCAGGC
CCATCTGTCTGCCCTTCTTTGATGAGGAGCTCACTCCAGCCACCCCACTCTGGATCATTGGA
TGGGGCTTTACGAAGCAGAATGGAGGGAAGATGTCTGACATACTGCTGCAGGCGTCAGTCCA
GGTCATTGACAGCACACGGTGCAATGCAGACGATGCGTACCAGGGGGAAGTCACCGAGAAGA
TGATGTGTGCAGGCATCCCGGAAGGGGTGTGGACACCTGCCAGGGTGACAGTGGTGGGCCC
CTGATGTACCAATCTGACCAGTGGCATGTGGTGGGCATCGTTAGCTGGGGCTATGGCTGCGG
GGGCCCGAGCACCCCAGGAGTATACACCAAGGTCTCAGCCTATCTCAACTGGATCTACAATG
TCTGGAAGGCTGAGCTGTAATGCTGCTGCCCCTTTGCAGTGCTGGGAGCCGCTTCCTTCCTG
CCCTGCCCACCTGGGGATCCCCAAAGTCAGACACAGAGCAAGAGTCCCCTTGGGTACACCC
CTCTGCCCACAGCCTCAGCATTTCTTGGAGCAGCAAAGGGCCTCAATTCCTGTAAGAGACCC
TCGCAGCCCAGAGGCGCCCAGAGGAAGTCAGCAGCCCTAGCTCGGCCACACTTGGTGCTCCC
AGCATCCCAGGGAGAGACACAGCCCACTGAACAAGGTCTCAGGGGTATTGCTAAGCCAAGAA
GGAACTTTCCCACACTACTGAATGGAAGCAGGCTGTCTTGTAAAGCCCAGATCACTGTGGG
CTGGAGAGGAGAAGGAAAGGGTCTGCGCCAGCCCTGTCCGTCTTCACCCATCCCCAAGCCTA
CTAGAGCAAGAAACCAGTTGTAATATAAAATGCACTGCCCTACTGTTGGTATGACTACCGTT
ACCTACTGTTGTCATTGTTATTACAGCTATGGCCACTATTATTAAAGAGCTGTGTAACATCT
CTGGCAAAAAAAAAAAA

FIGURE 156

></usr/seqdb2/sst/DNA/Dnaseqs.min/ss.DNA68885
><subunit 1 of 1, 432 aa, 1 stop
><MW: 47644, pI: 5.18, NX(S/T): 2
MLQDPDSDQPLNSLDVKPLRKPRIPMETFRKVGIPIIIALLSLASIIIVVVLIKVILDKYYF
LCGQPLHFIPRKQLCDGELDCPLGEDEEHCVKSFPEGPAVAVRLSKDRSTLQVLDSATGNWF
SACFDNFTEALAETACRQMGYSRAVEIGPDQDLDVVEITENSQELRMRNSSGPCLSGSLVSL
HCLACGKSLKTPRVVGGEEASVDSWPWQVSIQYDKQHVCGGSILDPHWVLTAAHCFRKHTDV
FNWKVRAGSDKLGSFPSLAVAKIIIIEFNPMYPKDNDIALMKLQFPLTFSGTVRPICLPFFD
EELTPATPLWIIGWGFTKQNGGKMSDILLQASVQVIDSTRCNADDAYQGEVTEKMMCAGIPE
GGVDTCQGDSGGPLMYQSDQWHVVGIVSWGYGCGGPSTPGVYTKVSAYLNWIYNVWKAEL

Transmembrane domain:
amino acids 32-53 (typeII)

FIGURE 157

```
GGGCTGAGGCACTGAGAGACCGGAAAGCCTGGCATTCCAGAGGGAGGGAAACGCAGCGGCATCCCCAGGCTCCAG
AGCTCCCTGGTGACAGTCTGTGGCTGAGCATGGCCCTCCCAGCCCTGGGCCTGGACCCCTGGAGCCTCCTGGGCC
TTTTCCTCTTCCAACTGCTTCAGCTGCTGCTGCCGACGACGACCGCGGGGGGAGGCGGGCAGGGGCCCATGCCCA
GGGTCAGATACTATGCAGGGGATGAACGTAGGGCACTTAGCTTCTTCCACCAGAAGGGCCTCCAGGATTTTGACA
CTCTGCTCCTGAGTGGTGATGGAAATACTCTCTACGTGGGGGCTCGAGAAGCCATTCTGGCCTTGGATATCCAGG
ATCCAGGGGTCCCCAGGCTAAAGAACATGATACCGTGGCCAGCCAGTGACAGAAAAAAGAGTGAATGTGCCTTTA
AGAAGAAGAGCAATGAGACACAGTGTTTCAACTTCATCCGTGTCCTGGTTTCTTACAATGTCACCCATCTCTACA
CCTGCGGCACCTTCGCCTTCAGCCCTGCTTGTACCTTCATTGAACTTCAAGATTCCTACCTGTTGCCCATCTCGG
AGGACAAGGTCATGGAGGGAAAAGGCCAAAGCCCCTTTGACCCCGCTCACAAGCATACGGCTGTCTTGGTGGATG
GGATGCTCTATTCTGGTACTATGAACAACTTCCTGGGCAGTGAGCCCATCCTGATGCGCACACTGGGATCCCAGC
CTGTCCTCAAGACCGACAACTTCCTCCGCTGGCTGCATCATGACGCCTCCTTTGTGGCAGCCATCCCTTCGACCC
AGGTCGTCTACTTCTTCTTCGAGGAGACAGCCAGCGAGTTTGACTTCTTTGAGAGGCTCCACACATCGCGGGTGG
CTAGAGTCTGCAAGAATGACGTGGCGGCGAAAAGCTGCTGCAGAAGAAGTGGACCACCTTCCTGAAGGCCCAGC
TGCTCTGCACCCAGCCGGGGCAGCTGCCCTTCAACGTCATCCGCCACGCGGTCCTGCTCCCCGCCGATTCTCCCA
CAGCTCCCCACATCTACGCAGTCTTCACCTCCCAGTGGCAGGTTGGCGGGACCAGGAGCTCTGCGGTTTGTGCCT
TCTCTCTCTTGGACATTGAACGTGTCTTTAAGGGGAAATACAAAGAGTTGAACAAAGAAACTTCACGCTGGACTA
CTTATAGGGGCCCTGAGACCAACCCCCGGCCAGGCAGTTGCTCAGTGGGCCCCTCCTCTGATAAGGCCCTGACCT
TCATGAAGGACCATTTCCTGATGGATGAGCAAGTGGTGGGGACGCCCCTGCTGGTGAAATCGGCGTGGAGTATA
CACGGCTTGCAGTGGAGACAGCCCAGGGCCTTGATGGGCACAGCCATCTTGTCATGTACCTGGGAACCACCACAG
GGTCGCTCCACAAGGCTGTGGTAAGTGGGGACAGCAGTGCTCATCTGGTGGAAGAGATTCAGCTGTTCCCTGACC
CTGAACCTGTTCGCAACCTGCAGCTGGCCCCCACCCAGGGTGCAGTGTTTGTAGGCTTCTCAGGAGGTGTCTGGA
GGGTGCCCCGAGCCAACTGTAGTGTCTATGAGAGCTGTGTGGACTGTGTCCTTGCCCGGGACCCCCACTGTGCCT
GGGACCCTGAGTCCCGAACCTGTTGCCTCCTGTCTGCCCCCAACCTGAACTCCTGGAAGCAGGACATGGAGCGGG
GGAACCCAGAGTGGGCATGTGCCAGTGGCCCCATGAGCAGGAGCCTTCGGCCTCAGAGCCGCCCGCAAATCATTA
AAGAAGTCCTGGCTGTCCCCAACTCCATCCTGGAGCTCCCCTGCCCCCACCTGTCAGCCTTGGCCTCTTATTATT
GGAGTCATGGCCCAGCAGCAGTCCCAGAAGCCTCTTCCACTGTCTACAATGGCTCCCTCTTGCTGATAGTGCAGG
ATGGAGTTGGGGGTCTCTACCAGTGCTGGGCAACTGAGAATGGCTTTTCATACCCTGTGATCTCCTACTGGGTGG
ACAGCCAGGACCAGACCCTGGCCCTGGATCCTGAACTGGCAGGCATCCCCGGGAGCATGTGAAGGTCCCGTTGA
CCAGGGTCAGTGGTGGGGCCGCCCTGGCTGCCCAGCAGTCCTACTGGCCCCACTTTGTCACTGTCACTGTCCTCT
TTGCCTTAGTGCTTTCAGGAGCCCTCATCATCCTCGTGGCCTCCCCATTGAGAGCACTCCGGGCTCGGGGCAAGG
TTCAGGGCTGTGAGACCCTGCGCCCTGGGGAGAAGGCCCCGTTAAGCAGAGAGCAACACCTCCAGTCTCCCAAGG
AATGCAGGACCTCTGCCAGTGATGTGGACGCTGACAACAACTGCCTAGGCACTGAGGTAGCTTAAACTCTAGGCA
CAGGCCGGGGCTGCGGTGCAGGCACCTGGCCATGCTGGCTGGGCGGCCCAAGCACAGCCCTGACTAGGATGACAG
CAGCACAAAAGACCACCTTTCTCCCCTGAGAGGAGCTTCTGCTACTCTGCATCACTGATGACACTCAGCAGGGTG
ATGCACAGCAGTCTGCCTCCCCTATGGGACTCCCTTCTACCAAGCACATGAGCTCTCTAACAGGGTGGGGCTAC
CCCCAGACCTGCTCCTACACTGATATTGAAGAACCTGGAGAGGATCCTTCAGTTCTGGCCATTCCAGGGACCCTC
CAGAAACACAGTGTTTCAAGAGACCCTAAAAAACCTGCCTGTCCCAGGACCCTATGGTAATGAACACCAAACATC
TAAACAATCATATGCTAACATGCCACTCCTGGAAACTCCACTCTGAAGCTGCCGCTTTGGACACCAACACTCCCT
TCTCCCAGGGTCATGCAGGGATCTGCTCCCTCCTGCTTCCCTTACCAGTCGTGCACCGCTGACTCCCAGGAAGTC
TTTCCTGAAGTCTGACCACCTTTCTTCTTGCTTCAGTTGGGGCAGACTCTGATCCCTTCTGCCCTGGCAGAATGG
CAGGGGTAATCTGAGCCTTCTTCACTCCTTTACCCTAGCTGACCCCTTCACCTCTCCCCCTCCCTTTTCCTTTGT
TTTGGGATTCAGAAAACTGCTTGTCAGAGACTGTTTATTTTTTATTAAAAATATAAGGCTTAAAAAAA
```

FIGURE 158

></usr/seqdb2/sst/DNA/Dnaseqs.min/ss.DNA71166
><subunit 1 of 1, 761 aa, 1 stop
><MW: 83574, pI: 6.78, NX(S/T): 4
MALPALGLDPWSLLGLFLFQLLQLLLPTTTAGGGGQGPMPRVRYYAGDERRALSFFHQKGLQ
DFDTLLLSGDGNTLYVGAREAILALDIQDPGVPRLKNMIPWPASDRKKSECAFKKKSNETQC
FNFIRVLVSYNVTHLYTCGTFAFSPACTFIELQDSYLLPISEDKVMEGKGQSPFDPAHKHTA
VLVDGMLYSGTMNNFLGSEPILMRTLGSQPVLKTDNFLRWLHHDASFVAAIPSTQVVYFFFE
ETASEFDFFERLHTSRVARVCKNDVGGEKLLQKKWTTFLKAQLLCTQPGQLPFNVIRHAVLL
PADSPTAPHIYAVFTSQWQVGGTRSSAVCAFSLLDIERVFKGKYKELNKETSRWTTYRGPET
NPRPGSCSVGPSSDKALTFMKDHFLMDEQVVGTPLLVKSGVEYTRLAVETAQGLDGHSHLVM
YLGTTTGSLHKAVVSGDSSAHLVEEIQLFPDPEPVRNLQLAPTQGAVFVGFSGGVWRVPRAN
CSVYESCVDCVLARDPHCAWDPESRTCCLLSAPNLNSWKQDMERGNPEWACASGPMSRSLRP
QSRPQIIKEVLAVPNSILELPCPHLSALASYYWSHGPAAVPEASSTVYNGSLLLIVQDGVGG
LYQCWATENGFSYPVISYWVDSQDQTLALDPELAGIPREHVKVPLTRVSGGAALAAQQSYWP
HFVTVTVLFALVLSGALIILVASPLRALRARGKVQGCETLRPGEKAPLSREQHLQSPKECRT
SASDVDADNNCLGTEVA

Signal peptide:
amino acids 1-30

Transmembrane domains:
amino acids 136-156, 222-247, 474-490, 685-704

FIGURE 159

AGGGTCCCTTAGCCGGGCGCAGGGCGCGCAGCCCAGGCTGAGATCCGCGGCTTCCGTAGAAG
TGAGCATGGCTGGGCAGCGAGTGCTTCTTCTAGTGGGCTTCCTTCTCCCTGGGGTCCTGCTC
TCAGAGGCTGCCAAAATCCTGACAATATCTACAGTAGGTGGAAGCCATTATCTACTGATGGA
CCGGGTTTCTCAGATTCTTCAAGATCACGGTCATAATGTCACCATGCTTAACCACAAAAGAG
GTCCTTTTATGCCAGATTTTAAAAAGGAAGAAAAATCATATCAAGTTATCAGTTGGCTTGCA
CCTGAAGATCATCAAAGAGAATTTAAAAAGAGTTTTGATTTCTTTCTGGAAGAAACTTTAGG
TGGCAGAGGAAAATTTGAAAACTTATTAAATGTTCTAGAATACTTGGCGTTGCAGTGCAGTC
ATTTTTTAAATAGAAAGGATATCATGGATTCCTTAAAGAATGAGAACTTCGACATGGTGATA
GTTGAAACTTTTGACTACTGTCCTTTCCTGATTGCTGAGAAGCTTGGGAAGCCATTTGTGGC
CATTCTTTCCACTTCATTCGGCTCTTTGGAATTTGGGCTACCAATCCCCTTGTCTTATGTTC
CAGTATTCCGTTCCTTGCTGACTGATCACATGGACTTCTGGGCCGAGTGAAGAATTTTCTG
ATGTTCTTTAGTTTCTGCAGGAGGCAACAGCACATGCAGTCTACATTTGACAACACCATCAA
GGAACATTTCACAGAAGGCTCTAGGCCAGTTTTGTCTCATCTTCTACTGAAAGCAGAGTTGT
GGTTCATTAACTCTGACTTTGCCTTTGATTTTGCTCGACCTCTGCTTCCCAACACTGTTTAT
GTTGGAGGCTTGATGGAAAAACCTATTAAACCAGTACCACAAGACTTGGAGAACTTCATTGC
CAAGTTTGGGGACTCTGGTTTTGTCCTTGTGACCTTGGGCTCCATGGTGAACACCTGTCAGA
ATCCGGAAATCTTCAAGGAGATGAACAATGCCTTTGCTCACCTACCCCAAGGGGTGATATGG
AAGTGTCAGTGTTCTCATTGGCCCAAAGATGTCCACCTGGCTGCAAATGTGAAAATTGTGGA
CTGGCTTCCTCAGAGTGACCTCCTGGCTCACCCAAGCATCCGTCTGTTTGTCACCCACGGCG
GGCAGAATAGCATAATGGAGGCCATCCAGCATGGTGTGCCCATGGTGGGGATCCCTCTCTTT
GGAGACCAGCCTGAAAACATGGTCCGAGTAGAAGCCAAAAAGTTTGGTGTTTCTATTCAGTT
AAAGAAGCTCAAGGCAGAGACATTGGCTCTTAAGATGAAACAAATCATGGAAGACAAGAGAT
ACAAGTCCGCGGCAGTGGCTGCCAGTGTCATCCTGCGCTCCCACCCGCTCAGCCCCACACAG
CGGCTGGTGGGCTGGATTGACCACGTCCTCCAGACAGGGGGCGCGACGCACCTCAAGCCCTA
TGTCTTTCAGCAGCCCTGGCATGAGCAGTACCTGTTCGACGTTTTTGTGTTTCTGCTGGGGC
TCACTCTGGGGACTCTATGGCTTTGTGGGAAGCTGCTGGGCATGGCTGTCTGGTGGCTGCGT
GGGGCCAGAAAGGTGAAGGAGACATAAGGCCAGGTGCAGCCTTGGCGGGGTCTGTTTGGTGG
GCGATGTCACCATTTCTAGGGAGCTTCCCACTAGTTCTGGCAGCCCCATTCTCTAGTCCTTC
TAGTTATCTCCTGTTTTCTTGAAGAACAGGAAAAATGGCCAAAAATCATCCTTTCCACTTGC
TAATTTTGCTACAAATTCATCCTTACTAGCTCCTGCCTGCTAGCAGAAATCTTTCCAGTCCT
CTTGTCCTCCTTTGTTTGCCATCAGCAAGGGCTATGCTGTGATTCTGTCTCTGAGTGACTTG
GACCACTGACCCTCAGATTTCCAGCCTTAAAATCCACCTTCCTTCTCATGCGCCTCTCCGAA
TCACACCCTGACTCTTCCAGCCTCCATGTCCAGACCTAGTCAGCCTCTCTCACTCCTGCCCC
TACTATCTATCATGGAATAACATCCAAGAAAGACACCTTGCATATTCTTTCAGTTTCTGTTT
TGTTCTCCCACATATTCTCTTCAATGCTCAGGAAGCCTGCCCTGTGCTTGAGAGTTCAGGGC
CGGACACAGGCTCACAGGTCTCCACATTGGGTCCCTGTCTCTGGTGCCCACAGTGAGCTCCT
TCTTGGCTGAGCAGGCATGGAGACTGTAGGTTTCCAGATTTCCTGAAAAATAAAAGTTTACA
GCGTTATCTCTCCCCAACCTCACTAA

FIGURE 160

></usr/seqdb2/sst/DNA/Dnaseqs.min/ss.DNA71169
><subunit 1 of 1, 523 aa, 1 stop
><MW: 59581, pI: 8.68, NX(S/T): 1
MAGQRVLLLVGFLLPGVLLSEAAKILTISTVGGSHYLLMDRVSQILQDHGHNVTMLNHKRGP
FMPDFKKEEKSYQVISWLAPEDHQREFKKSFDFFLEETLGGRGKFENLLNVLEYLALQCSHF
LNRKDIMDSLKNENFDMVIVETFDYCPFLIAEKLGKPFVAILSTSFGSLEFGLPIPLSYVPV
FRSLLTDHMDFWGRVKNFLMFFSFCRRQQHMQSTFDNTIKEHFTEGSRPVLSHLLLKAELWF
INSDFAFDFARPLLPNTVYVGGLMEKPIKPVPQDLENFIAKFGDSGFVLVTLGSMVNTCQNP
EIFKEMNNAFAHLPQGVIWKCQCSHWPKDVHLAANVKIVDWLPQSDLLAHPSIRLFVTHGGQ
NSIMEAIQHGVPMVGIPLFGDQPENMVRVEAKKFGVSIQLKKLKAETLALKMKQIMEDKRYK
SAAVAASVILRSHPLSPTQRLVGWIDHVLQTGGATHLKPYVFQQPWHEQYLFDVFVFLLGLT
LGTLWLCGKLLGMAVWWLRGARKVKET

Signal peptide:
amino acids 1-19

Transmembrane domain:
amino acids 483-504

FIGURE 161

```
GGGCTGTTGATTTGTGGGGATTTTGAAGAGAGGAGGAATAGGAGGAAGGGGTTGAGGGGCT
GCCTCTGGCATATGCACACACTCACACATTCTGTCACACCCGTCACACACACATACCATGTT
CTCCATCCCCCAGGTCCAGCCCTCAGTGCTGTCCCATCCAGCAGGGCTACCCTGAAGCTCT
GGCTGCAGCCCTCCCGTCCAGTGGGCAGGCGGCTTCATCCCTCCTTTCTCTCCCAAAGCCCA
ACTGCTGTCACTGCATGCTCTGCCAAGGAGGAGGGAACTGCAGTGACAGCAGGAGTAAGAGT
GGGAGGCAGGACAGAGCTGGGACACAGGTATGGAGAGGGGGTTCAGCGAGCCTAGAGAGGGC
AGACTATCAGGGTGCCGGCGGTGAGAATCCAGGGAGAGGAGCGGAAACAGAAGAGGGGCAGA
AGACCGGGGCACTTGTGGGTTGCAGAGCCCCTCAGCCATGTTGGGAGCCAAGCCACACTGGC
TACCAGGTCCCCTACACAGTCCCGGGCTGCCCTTGGTTCTGGTGCTTCTGGCCCTGGGGGCC
GGGTGGGCCCAGGAGGGGTCAGAGCCCGTCCTGCTGGAGGGGGAGTGCCTGGTGGTCTGTGA
GCCTGGCCGAGCTGCTGCAGGGGGGCCCGGGGGAGCAGCCCTGGGAGAGGCACCCCCTGGGC
GAGTGGCATTTGCTGCGGTCCGAAGCCACCACCATGAGCCAGCAGGGGAAACCGGCAATGGC
ACCAGTGGGGCCATCTACTTCGACCAGGTCCTGGTGAACGAGGGCGGTGGCTTTGACCGGGC
CTCTGGCTCCTTCGTAGCCCCTGTCCGGGGTGTCTACAGCTTCCGGTTCCATGTGGTGAAGG
TGTACAACCGCCAAACTGTCCAGGTGAGCCTGATGCTGAACACGTGGCCTGTCATCTCAGCC
TTTGCCAATGATCCTGACGTGACCCGGGAGGCAGCCACCAGCTCTGTGCTACTGCCCTTGGA
CCCTGGGGACCGAGTGTCTCTGCGCCTGCGTCGGGGGAATCTACTGGGTGGTTGGAAATACT
CAAGTTTCTCTGGCTTCCTCATCTTCCCTCTCTGAGGACCCAAGTCTTTCAAGCACAAGAAT
CCAGCCCCTGACAACTTTCTTCTGCCCTCTCTTGCCCCAGAAACAGCAGAGGCAGGAGAGAG
ACTCCCTCTGGCTCCTATCCCACCTCTTTGCATGGGACCCTGTGCCAAACACCCAAGTTTAA
GAGAAGAGTAGAGCTGTGGCATCTCCAGACCAGGCCTTTCCACCCACCCACCCCCAGTTACC
CTCCCAGCCACCTGCTGCATCTGTTCCTGCCTGCAGCCCTAGGATCAGGGCAAGGTTTGGCA
AGAAGGAAGATCTGCACTACTTTGCGGCCTCTGCTCCTCCGGTTCCCCCACCCCAGCTTCCT
GCTCAATGCTGATCAGGGACAGGTGGCGCAGGTGAGCCTGACAGGCCCCACAGGAGCCCAG
ATGGACAAGCCTCAGCGTACCCTGCAGGCTTCTTCCTGTGAGGAAAGCCAGCATCACGGATC
TCAGCCAGCACCGTCAGAAGCTGAGCCAGCACCGTATGGGCTAGGGTGGGAGGCTCAGCCAC
AGGCAGAAGGGTGGGAAGGGCCTGGAGTCTGTGGCTGGTGAGGAAGGAAGGAGGGTGTATTG
TCTAGACTGAACATGGTACACATTCTGCATGTATAGCAGAGCAGCCAGCAGGTAGCAATCCT
GGCTGTCCTTCTATGCTGGATCCCAGATGGACTCTGGCCCTTACCTCCCCACCTGAGATTAG
GGTGAGTGTGTTTGCTCTGGCTGAGAGCAGAGCTGAGAGCAGGTATACAGAGCTGGAAGTGG
ACCATGGAAAACATCGATAACCATGCATCCTCTTGCTTGGCCACCTCCTGAAACTGCTCCAC
CTTTGAAGTTTGAACTTTAGTCCCTCCACACTCTGACTGCTGCCTCCTTCCTCCCAGCTCTC
TCACTGAGTTATCTTCACTGTACCTGTTCCAGCATATCCCCACTATCTCTCTTTCTCCTGAT
CTGTGCTGTCTTATTCTCCTCCTTAGGCTTCCTATTACCTGGGATTCCATGATTCATTCCTT
CAGACCCTCTCCTGCCAGTATGCTAAACCCTCCCTCTCTTTCTTATCCCGCTGTCCCATT
GGCCCAGCCTGGATGAATCTATCAATAAAACAACTAGAGAATGGTGGTCAGTGAGACACTAT
AGAATTACTAAGGAGAAGATGCCTCTGGAGTTTGGATCGGGTGTTACAGGTACAAGTAGGTA
TGTTGCAGAGGAAAATAAATATCAAACTGTATACTAAAATTAAAAA
```

FIGURE 162

></usr/seqdb2/sst/DNA/Dnaseqs.min/ss.DNA71180
><subunit 1 of 1, 205 aa, 1 stop
><MW: 21521, pI: 7.07, NX(S/T): 1
MLGAKPHWLPGPLHSPGLPLVLVLLALGAGWAQEGSEPVLLEGECLVVCEPGRAAAGGPGGA
ALGEAPPGRVAFAAVRSHHHEPAGETGNGTSGAIYFDQVLVNEGGGFDRASGSFVAPVRGVY
SFRFHVVKVYNRQTVQVSLMLNTWPVISAFANDPDVTREAATSSVLLPLDPGDRVSLRLRRG
NLLGGWKYSSFSGFLIFPL

Signal peptide:
amino acids 1-32

FIGURE 163

```
GCTGTTTCTCTCGCGCCACCACTGGCCGCCGGCCGCAGCTCCAGGTGTCCTAGCCGCCCAGC
CTCGACGCCGTCCCGGGACCCCTGTGCTCTGCGCGAAGCCCTGGCCCCGGGGGCCGGGGCAT
GGGCCAGGGGCGCGGGGTGAAGCGGCTTCCCGCGGGGCCGTGACTGGGCGGGCTTCAGCCAT
GAAGACCCTCATAGCCGCCTACTCCGGGGTCCTGCGCGGCGAGCGTCAGGCCGAGGCTGACC
GGAGCCAGCGCTCTCACGGAGGACCTGCGCTGTCGCGCGAGGGGTCTGGGAGATGGGGCACT
GGATCCAGCATCCTCTCCGCCCTCCAGGACCTCTTCTCTGTCACCTGGCTCAATAGGTCCAA
GGTGGAAAAGCAGCTACAGGTCATCTCAGTGCTCCAGTGGGTCCTGTCCTTCCTTGTACTGG
GAGTGGCCTGCAGTGCCATCCTCATGTACATATTCTGCACTGATTGCTGGCTCATCGCTGTG
CTCTACTTCACTTGGCTGGTGTTTGACTGGAACACACCCAAGAAAGGTGGCAGGAGGTCACA
GTGGGTCCGAAACTGGGCTGTGTGGCGCTACTTTCGAGACTACTTTCCCATCCAGCTGGTGA
AGACACACAACCTGCTGACCACCAGGAACTATATCTTTGGATACCACCCCCATGGTATCATG
GGCCTGGGTGCCTTCTGCAACTTCAGCACAGAGGCCACAGAAGTGAGCAAGAAGTTCCCAGG
CATACGGCCTTACCTGGCTACACTGGCAGGCAACTTCCGAATGCCTGTGTTGAGGGAGTACC
TGATGTCTGGAGGTATCTGCCCTGTCAGCCGGGACACCATAGACTATTTGCTTTCAAAGAAT
GGGAGTGGCAATGCTATCATCATCGTGGTCGGGGGTGCGGCTGAGTCTCTGAGCTCCATGCC
TGGCAAGAATGCAGTCACCCTGCGGAACCGCAAGGGCTTTGTGAAACTGGCCCTGCGTCATG
GAGCTGACCTGGTTCCCATCTACTCCTTTGGAGAGAATGAAGTGTACAAGCAGGTGATCTTC
GAGGAGGGCTCCTGGGGCCGATGGGTCCAGAAGAAGTTCCAGAAATACATTGGTTTCGCCCC
ATGCATCTTCCATGGTCGAGGCCTCTTCTCCTCCGACACCTGGGGGCTGGTGCCCTACTCCA
AGCCCATCACCACTGTTGTGGGAGAGCCCATCACCATCCCCAAGCTGGAGCACCCAACCCAG
CAAGACATCGACCTGTACCACACCATGTACATGGAGGCCCTGGTGAAGCTCTTCGACAAGCA
CAAGACCAAGTTCGGCCTCCCGGAGACTGAGGTCCTGGAGGTGAACTGAGCCAGCCTTCGGG
GCCAATTCCCTGGAGGAACCAGCTGCAAATCACTTTTTTGCTCTGTAAATTTGGAAGTGTCA
TGGGTGTCTGTGGGTTATTTAAAAGAAATTATAACAATTTTGCTAAACCAAAAAAAAAAAAA
AAAAAAAAAAAAAAAAAAAAAAAAAAAAAAAAAAAAAAAAAAAAAAAAAAAAAAAAAAAAAA
AAAAAAAAAAAAAAAAAAAA
```

FIGURE 164

></usr/seqdb2/sst/DNA/Dnaseqs.min/ss.DNA71184
><subunit 1 of 1, 388 aa, 1 stop
><MW: 43831, pI: 9.64, NX(S/T): 3
MKTLIAAYSGVLRGERQAEADRSQRSHGGPALSREGSGRWGTGSSILSALQDLFSVTWLNRS
KVEKQLQVISVLQWVLSFLVLGVACSAILMYIFCTDCWLIAVLYFTWLVFDWNTPKKGGRRS
QWVRNWAVWRYFRDYFPIQLVKTHNLLTTRNYIFGYHPHGIMGLGAFCNFSTEATEVSKKFP
GIRPYLATLAGNFRMPVLREYLMSGGICPVSRDTIDYLLSKNGSGNAIIIVVGGAAESLSSM
PGKNAVTLRNRKGFVKLALRHGADLVPIYSFGENEVYKQVIFEEGSWGRWVQKKFQKYIGFA
PCIFHGRGLFSSDTWGLVPYSKPITTVVGEPITIPKLEHPTQQDIDLYHTMYMEALVKLFDK
HKTKFGLPETEVLEVN

Important features of the protein:
Transmembrane domain:
amino acids 76-97

N-glycosylation sites.
amino acids 60-63, 173-176, 228-231

N-myristoylation sites.
amino acids 10-15, 41-46, 84-89, 120-125, 169-174, 229-234, 240-245, 318-323, 378-383

FIGURE 165

```
GGGCGGCGGGATGGGGGCCGGGGGCGGCGGGCGCCGCACTCGCTGAGGCCCCGACGCAGGGCCGGGCCGGGCCCA
GGGCCGAGGAGCGCGGCGGCCAGAGCGGGGCCGCGGAGGCGACGCCGGGGACGCCCGCGCGACGAGCAGGTGGCG
GCGGCTGCAGGCTTGTCCAGCCGGAAGCCCTGAGGGCAGCTGTTCCCACTGGCTCTGCTGACCTTGTGCCTTGGA
CGGCTGTCCTCAGCGAGGGGCCGTGCACCCGCTCCTGAGCAGCGCCATGGGCCTGCTGGCCTTCCTGAAGACCCA
GTTCGTGCTGCACCTGCTGGTCGGCTTTGTCTTCGTGGTGAGTGGTCTGGTCATCAACTTCGTCCAGCTGTGCAC
GCTGGCGCTCTGGCCGGTCAGCAAGCAGCTCTACCGCCGCCTCAACTGCCGCCTCGCCTACTCACTCTGGAGCCA
ACTGGTCATGCTGCTGGAGTGGTGGTCCTGCACGGAGTGTACACTGTTCACGGACCAGGCCACGGTAGAGCGCTT
TGGGAAGGAGCACGCAGTCATCATCCTCAACCACAACTTCGAGATCGACTTCCTCTGTGGGTGGACCATGTGTGA
GCGCTTCGGAGTGCTGGGGAGCTCCAAGGTCCTCGCTAAGAAGGAGCTGCTCTACGTGCCCCTCATCGGCTGGAC
GTGGTACTTTCTGGAGATTGTGTTCTGCAAGCGGAAGTGGGAGGAGGACCGGGACACCGTGGTCGAAGGGCTGAG
GCGCCTGTCGGACTACCCCGAGTACATGTGGTTTCTCCTGTACTGCGAGGGGACGCGCTTCACGGAGACCAAGCA
CCGCGTTAGCATGGAGGTGGCGGCTGCTAAGGGGCTTCCTGTCCTCAAGTACCACCTGCTGCCGCGGACCAAGGG
CTTCACCACCGCAGTCAAGTGCCTCCGGGGACAGTCGCAGCTGTCTATGATGTAACCCTGAACTTCAGAGGAAA
CAAGAACCCGTCCCTGCTGGGGATCCTCTACGGGAAGAAGTACGAGGCGGACATGTGCGTGAGGAGATTTCCTCT
GGAAGACATCCCGCTGGATGAAAAGGAAGCAGCTCAGTGGCTTCATAAACTGTACCAGGAGAAGGACGCGCTCCA
GGAGATATATAATCAGAAGGGCATGTTTCCAGGGGAGCAGTTTAAGCCTGCCCGGAGGCCGTGGACCCTCCTGAA
CTTCCTGTCCTGGGCCACCATTCTCCTGTCTCCCCTCTTCAGTTTTGTCTTGGGCGTCTTTGCCAGCGGATCACC
TCTCCTGATCCTGACTTTCTTGGGGTTTGTGGGAGCAGCTTCCTTTGGAGTTCGCAGACTGATAGGAGAATCGCT
TGAACCTGGGAGGTGGAGATTGCAGTGAGCTGAGATGGCATCACTGTACTCCAGCCTAGGCAACAGAGCAAGACT
CAGTCTCAAAAAAAAAAAAAAACAAAAAAACCCCAGAAATTCTGGAGTTGAACTGTGTAGTTACTGACATGAAAA
ATTCACTAGAGGCTGAACAGCAGATTTGAGCAGGCAGAAAAAAATCAGCAAGCTTGAAGATGGTACCTTGAGATT
TTTCAGGCTAATGAAAAAAGAATGAAGGAAAATTAACAGCCTCAGAGACCCATGGTGCACCGTCACACAAATCAA
CATATGCATGATGAGAGTCCCAGAAGGAGAGGAGAGAAAGGGTCAGAAAGAATGGCCACAAGCTGATGAAAAACA
GTAACCTACCCACTCAGGAAGCTCAGTGAACTCCAATGAGGATGAATATCAGAGATCCACACCTAGATATTTCAT
AATCAAAGTGTCAAATGACAAAGAATCTTGAAAGCAGCAAGAGATGAGCAACTTATCTTGTTCAAAGGATCTTTG
ATCAGATTAACAGCTCATTTCTCCTCAGAAATCATGGGAGCCAGGAGATAGTGGGATGAACACTGTTGAAGGCAA
AACCTTCAACTGTAATTATTGGACTTTTGAGTCTTAGATGGTCCTGACCTCTTTGTCTTCAGGGACAGTTTTTCA
ATTTAATCCCTAATAACAATTAGTCAAGCTTCCTTGACCTGTAGGAAGGCCTGTCTTTAGGCCGGGCACAGTGGC
TTACACCTGTAATCCCAGCACTTTGGGAGGCCCAGACGGGTGGATCATTTGGGGTCAGGCTGATCTCAAACTCCT
GAGTTCAGGTGATCTGCCCGCCTCAGCCTCCCAAAGTGTTGTGATTGCAGGCGTGAGCCACTGCGCCTGGCCGGA
ATTTCTTTTTAAGGCTGAATGATGGGGGCCAGGCACGATGGCTCACGCCTGTGATCCCAAGTAGCTTGGATTGTA
AACATGCACCACCATGCCTGGCTAATTTTTGTATTTTTAGTAGAGACGTGTTAGCCAGGCTGGTCTCGATCTCCT
GACCTCAAGTGACCACCTGCCTCAGCCTCCCAAAGTACTGGGATTACAGGCGTGAGCCACTGTGCCTGGCCTTGA
GCATCTTGTGATGTGCTTATTGGCCATTTGTATATCTTCTATCTTCTTTGGGGAAATGTCTGTTCAAGTCCTTTG
CCTTTTTAAATTTTTATTATTTATTTATTTATTTTGAGACAGGGTCTTGTTCTGTTGCCCAGGCTGGAGTA
CAGTGGCACAGTCTTGGCTCACTGCAGCCTCGACCTCCTGGGCTGCAGTGATCCTCCCACCTCAGCCTCCCTTGT
AGCTGTATTTTTTGTATTTTGTATTTTGTAGCTGTAGTTTTTGTATTTTTGTGGAGACAGCATTTCACCATGA
TGCCCAGGCTGGTCTTGAACTCCTGAGCTCAAGTGATCTGCCTGCTTCAGCCTCCCAAAGTGCTGGGATTACAGA
CATGAGCCACTGCACCTGGCAAACTCCCAAAATTCAACACACACACAAAAAACCACCTGATTCAAAATGGGCA
GAGGGGCCGGGTGTGGCCCCAACTACCAGGGAGACTGAAGTGGGAGGATCGCTTGGGCATGAGAAGTCGAGGCTG
CAGTGAGTCGAGGTTGTGCGACTGCATTCCAGCCTGGACAACAGAGTGAGACCCTGTCTC
```

FIGURE 166

```
></usr/seqdb2/sst/DNA/Dnaseqs.min/ss.DNA71213
><subunit 1 of 1, 368 aa, 1 stop
><MW: 42550, pI: 9.11, NX(S/T): 1
MGLLAFLKTQFVLHLLVGFVFVVSGLVINFVQLCTLALWPVSKQLYRRLNCRLAYSLWSQLV
MLLEWWSCTECTLFTDQATVERFGKEHAVIILNHNFEIDFLCGWTMCERFGVLGSSKVLAKK
ELLYVPLIGWTWYFLEIVFCKRKWEEDRDTVVEGLRRLSDYPEYMWFLLYCEGTRFTETKHR
VSMEVAAAKGLPVLKYHLLPRTKGFTTAVKCLRGTVAAVYDVTLNFRGNKNPSLLGILYGKK
YEADMCVRRFPLEDIPLDEKEAAQWLHKLYQEKDALQEIYNQKGMFPGEQFKPARRPWTLLN
FLSWATILLSPLFSFVLGVFASGSPLLILTFLGFVGAASFGVRRLIGESLEPGRWRLQ
```

Important features of the protein:

Signal peptide:
amino acids 1-25

Transmembrane domains:
amino acids 307-323, 335-352

Tyrosine kinase phosphorylation sites.
amino acids 160-168, 161-169

FIGURE 167

GATATTCTTTATTTTTAAGAATCTGAAGTACTATGCATCACTCCCTCCAATGTCCTGGGGCA
GCCACCAGGCATATTCATCTTTGTGTGTGTTTTCTTTTGCTTTAGCACTGGGGCACTTCTT
GCTTATTTCTTTGGTAGGAAAGGGGCTCAGTTTGTCTTGTGGGGTTGGTGGCAGGCAGGCCG
GCTTACGCCTGATACGGCCCTGGGTTAGAAGGGAAGGGAAGATAAACTTTTATACAAATGGG
GATAGCTGGGGTCTGAGACCTGCTTCCTCAGTAAAATTCCTGGGATCTGCCTATACCTTCTT
TTCTCTAACCTGGCATACCCTGCTTAAAGCCTCTCAGGGCTTCTCTCTGTTCTTAGGATCAA
AGTATTTAGAGCTACAAGAGCCCTCATGGTCTGGCCCTGCCCCCCTGGCCAGCTTCATTGT
ACATGTGGTGTTCTCTTGTCGTTCCTGTAATGTGGTATGCCATGGGTCTTTGCACAAGCCT
TTCCTCTTTGGCTGGACACTGTTCCCTGCCCCCCCATACTCTTCCTACTTAATATGTAGTC
ATCCTGCAGATTTCAATTCTAACATCATTTTCTCCAGGGATCCTGGCCTGACAGAATCTCAT
CTTGTTTAATGCTCTCATAAGACCACTTGTTTCCCTTTTGCAGCACTTGCCACTCAGTTGTA
TCTTTATGTGCGTTTGTGGTTGTATGGGTTGTGTCTGTTCCCCAGAATGCCCAGCTCTGAGC
TGCGTGAGGGTCAAGGGCATTGCTGTGCCTGCCAGGTATAGTGCCTACATGTGGTGGGTGCT
CATGTTTTAGAGACTAAATGGAGGAGGAGATGAGGAAAAGATTGAAATCTCTCAGTTCACCA
GATGGTGTAGGGCCCAGCATTGTAAATTCACACGTTGACTGTGCTTGTGAATTATCTGGGGA
TGCAGGTCCTGATTCAGTAGGCCCAGGTTGGGCATCTCTAACAAACTCCCACGTGATGCTGA
TGCTGGTCCTATGAACTATACTAAATAGTAAGAATCTATGGAGCCAGGCTGGGCATGGTGGC
TCACACCTATGATCCCAGCACTTTGGGAGGCTGAGGCAGGCTGATCACCTGGAGTCAGGATT
TCAAGACTAGCCTGGCCAACATGGTGGAACCCCATCTGTACTAAAAATACACAAATTAGCTG
GGCATGGTGGCACATGCCTGTAGTCCCAGCTACTTGGGAGGCTGAAGCAAGAGAATCGCTTG
AACCTGGGAGGCGGAGGTTGCAGTGAGCCGAGATCAGGCCACTGTATTCCAACCAGGGTGAC
AGAGTGAGACTCTATGTCCAAAAAAAAAAAAA

FIGURE 168

></usr/seqdb2/sst/DNA/Dnaseqs.min/ss.DNA71234
><subunit 1 of 1, 143 aa, 1 stop
><MW: 15624, pI: 9.58, NX(S/T): 0
MHHSLQCPGAATRHIHLCVCFSFALALGHFLLISLVGKGLSLSCGVGGRQAGLRLIRPWVRR
EGKINFYTNGDSWGLRPASSVKFLGSAYTFFSLTWHTLLKASQGFSLFLGSKYLELQEPSWS
GPCPPGQLHCTCGVLLSFL

Important features of the protein:

Signal peptide:

amino acids 1-28

FIGURE 169

```
GGCTGGACTGGAACTCCTGGTCCCAAGTGATCCACCCGCCTCAGCCTCCCAAGGTGCTGTGA
TTATAGGTGTAAGCCACCGTGTCTGGCCTCTGAACAACTTTTTCAGCAACTAAAAAAGCCAC
AGGAGTTGAACTGCTAGGATTCTGACTATGCTGTGGTGGCTAGTGCTCCTACTCCTACCTAC
ATTAAAATCTGTTTTTTGTTCTCTTGTAACTAGCCTTTACCTTCCTAACACAGAGGATCTGT
CACTGTGGCTCTGGCCCAAACCTGACCTTCACTCTGGAACGAGAACAGAGGTTTCTACCCAC
ACCGTCCCCTCGAAGCCGGGGACAGCCTCACCTTGCTGGCCTCTCGCTGGAGCAGTGCCCTC
ACCAACTGTCTCACGTCTGGAGGCACTGACTCGGGCAGTGCAGGTAGCTGAGCCTCTTGGTA
GCTGCGGCTTTCAAGGTGGGCCTTGCCCTGGCCGTAGAAGGGATTGACAAGCCCGAAGATTT
CATAGGCGATGGCTCCCACTGCCCAGGCATCAGCCTTGCTGTAGTCAATCACTGCCCTGGGG
CCAGGACGGGCCGTGGACACCTGCTCAGAAGCAGTGGGTGAGACATCACGCTGCCCGCCCAT
CTAACCTTTTCATGTCCTGCACATCACCTGATCCATGGGCTAATCTGAACTCTGTCCCAAGG
AACCCAGAGCTTGAGTGAGCTGTGGCTCAGACCCAGAAGGGGTCTGCTTAGACCACCTGGTT
TATGTGACAGGACTTGCATTCTCCTGGAACATGAGGGAACGCCGGAGGAAAGCAAAGTGGCA
GGGAAGGAACTTGTGCCAAATTATGGGTCAGAAAAGATGGAGGTGTTGGGTTATCACAAGGC
ATCGAGTCTCCTGCATTCAGTGGACATGTGGGGGAAGGGCTGCCGATGGCGCATGACACACT
CGGGACTCACCTCTGGGGCCATCAGACAGCCGTTTCCGCCCCGATCCACGTACCAGCTGCTG
AAGGGCAACTGCAGGCCGATGCTCTCATCAGCCAGGCAGCAGCCAAAATCTGCGATCACCAG
CCAGGGGCAGCCGTCTGGGAAGGAGCAAGCAAAGTGACCATTTCTCCTCCCCTCCTTCCCTC
TGAGAGGCCCTCCTATGTCCCTACTAAAGCCACCAGCAAGACATAGCTGACAGGGGCTAATG
GCTCAGTGTTGGCCCAGGAGGTCAGCAAGGCCTGAGAGCTGATCAGAAGGGCCTGCTGTGCG
AACACGGAAATGCCTCCAGTAAGCACAGGCTGCAAAATCCCCAGGCAAAGGACTGTGTGGCT
CAATTTAAATCATGTTCTAGTAATTGGAGCTGTCCCCAAGACCAAAGGAGCTAGAGCTTGGT
TCAAATGATCTCCAAGGGCCCTTATACCCCAGGAGACTTTGATTTGAATTTGAAACCCCAAA
TCCAAACCTAAGAACCAGGTGCATTAAGAATCAGTTATTGCCGGGTGTGGTGGCCTGTAATG
CCAACATTTTGGGAGGCCGAGGCGGGTAGATCACCTGAGGTCAGGAGTTCAAGACCAGCCTG
GCCAACATGGTGAAACCCCTGTCTCTACTAAAAATACAAAAAAACTAGCCAGGCATGGTGGT
GTGTGCCTGTATCCCAGCTACTCGGGAGGCTGAGACAGGAGAATTACTTGAACCTGGGAGGT
GAAGGAGGCTGAGACAGGAGAATCACTTCAGCCTGAGCAACACAGCGAGACTCTGTCTCAGA
AAAAATAAAAAAGAATTATGGTTATTTGTAA
```

FIGURE 170

```
></usr/seqdb2/sst/DNA/Dnaseqs.min/ss.DNA71277
><subunit 1 of 1, 109 aa, 1 stop
><MW: 11822, pI: 8.63, NX(S/T): 0
MLWWLVLLLLPTLKSVFCSLVTSLYLPNTEDLSLWLWPKPDLHSGTRTEVSTHTVPSKPGTA
SPCWPLAGAVPSPTVSRLEALTRAVQVAEPLGSCGFQGGPCPGRRRD
```

Signal peptide:

amino acids 1-15

FIGURE 171

GCGGGCCCGCGAGTCCGAGACCTGTCCCAGGAGCTCCAGCTCACGTGACCTGTCACTGCCTC
CCGCCGCCTCCTGCCCGCGCCATGACCCAGCCGGTGCCCCGGCTCTCCGTGCCCGCCGCGCT
GGCCCTGGGCTCAGCCGCACTGGGCGCCGCCTTCGCCACTGGCCTCTTCCTGGGGAGGCGGT
GCCCCCATGGCGAGGCCGGCGAGAGCAGTGCCTGCTTCCCCCCGAGGACAGCCGCCTGTGG
CAGTATCTTCTGAGCCGCTCCATGCGGGAGCACCGGCGCTGCGAAGCCTGAGGCTGCTGAC
CCTGGAGCAGCCGCAGGGGATTCTATGATGACCTGCGAGCAGGCCCAGCTCTTGGCCAACC
TGGCGCGGCTCATCCAGGCCAAGAAGGCGCTGGACCTGGGCACCTTCACGGGCTACTCCGCC
CTGGCCCTGGCCCTGGCGCTGCCCGCGGACGGGCGCGTGGTGACCTGCGAGGTGGACGCGCA
GCCCCCGGAGCTGGGACGGCCCCTGTGGAGGCAGGCCGAGGCGGAGCACAAGATCGACCTCC
GGCTGAAGCCCGCCTTGGAGACCCTGGACGAGCTGCTGGCGGCGGGCGAGGCCGGCACCTTC
GACGTGGCCGTGGTGGATGCGGACAAGGAGAACTGCTCCGCCTACTACGAGCGCTGCCTGCA
GCTGCTGCGACCCGGAGGCATCCTCGCCGTCCTCAGAGTCCTGTGGCGCGGGAAGGTGCTGC
AACCTCCGAAAGGGGACGTGGCGGCCGAGTGTGTGCGAAACCTAAACGAACGCATCCGGCGG
GACGTCAGGGTCTACATCAGCCTCCTGCCCCTGGGCGATGGACTCACCTTGGCCTTCAAGAT
CTAGGGCTGGCCCCTAGTGAGTGGGCTCGAGGGAGGGTTGCCTGGGAACCCCAGGAATTGAC
CCTGAGTTTTAAATTCGAAAATAAAGTGGGGCTGGGACACAAAAAAAAAAAAAAAAAAA

FIGURE 172

></usr/seqdb2/sst/DNA/Dnaseqs.min/ss.DNA71282
><subunit 1 of 1, 262 aa, 1 stop
><MW: 28809, pI: 8.80, NX(S/T): 1
MTQPVPRLSVPAALALGSAALGAAFATGLFLGRRCPPWRGRREQCLLPPEDSRLWQYLLSRS
MREHPALRSLRLLTLEQPQGDSMMTCEQAQLLANLARLIQAKKALDLGTFTGYSALALALAL
PADGRVVTCEVDAQPPELGRPLWRQAEAEHKIDLRLKPALETLDELLAAGEAGTFDVAVVDA
DKENCSAYYERCLQLLRPGGILAVLRVLWRGKVLQPPKGDVAAECVRNLNERIRRDVRVYIS
LLPLGDGLTLAFKI

Important features of the protein:
Signal peptide:
amino acids 1-25

Transmembrane domains:
amino acids 8-30, 109-130

N-glycosylation site.
amino acids 190-193

Tyrosine kinase phosphorylation site.
amino acids 238-246

N-myristoylation sites.
amino acids 22-27, 28-33, 110-115, 205-210, 255-260

Amidation sites.
amino acids 31-34, 39-42

FIGURE 173

CCGCCGCCGCAGCCGCTACCGCCGCTGCAGCCGCTTTCCGCGGCCTGGGCCTCTCGCCGTCA
GCATGCCACACGCCTTCAAGCCCGGGGACTTGGTGTTCGCTAAGATGAAGGGCTACCCTCAC
TGGCCTGCCAGGATCGACGACATCGCGGATGGCGCCGTGAAGCCCCCACCCAACAAGTACCC
CATCTTTTCTTTGGCACACACGAAACAGCCTTCCTGGGACCCAAGGACCTGTTCCCCTACG
ACAAATGTAAAGACAAGTACGGGAAGCCCAACAAGAGGAAAGGCTTCAATGAAGGGCTGTGG
GAGATCCAGAACAACCCCCACGCCAGCTACAGCGCCCCTCCGCCAGTGAGCTCCTCCGACAG
CGAGGCCCCGAGGCCAACCCCGCCGACGGCAGTGACGCTGACGAGGACGATGAGGACCGGG
GGGTCATGGCCGTCACAGCGGTAACCGCCACAGCTGCCAGCGACAGGATGGAGAGCGACTCA
GACTCAGACAAGAGTAGCGACAACAGTGGCCTGAAGAGGAAGACGCCTGCGCTAAAGATGTC
GGTCTCGAAACGAGCCCGAAAGGCCTCCAGCGACCTGGATCAGGCCAGCGTGTCCCCATCCG
AAGAGGAGAACTCGGAAAGCTCATCTGAGTCGGAGAAGACCAGCGACCAGGACTTCACACCT
GAGAAGAAAGCAGCGGTCCGGGCGCCACGGAGGGGCCCTCTGGGGGGACGGAAAAAAAAGAA
GGCGCCGTCAGCCTCCGACTCCGACTCCAAGGCCGATTCGGACGGGGCCAAGCCTGAGCCGG
TGGCCATGGCGCGGTCGGCGTCCTCCTCCTCCTCTTCCTCCTCCTCCTCCGACTCCGATGTG
TCTGTGAAGAAGCCTCCGAGGGGCAGGAAGCCAGCGGAGAAGCCTCTCCCGAAGCCGCGAGG
GCGGAAACCGAAGCCTGAACGGCCTCCGTCCAGCTCCAGCAGTGACAGTGACAGCGACGAGG
TGGACCGCATCAGTGAGTGGAAGCGGCGGGACGAGGCGCGGAGGCGCGAGCTGGAGGCCCGG
CGGCGGCGAGAGCAGGAGGAGGAGCTGCGGCGCCTGCGGGAGCAGGAGAAGGAGGAGAAGGA
GCGGAGGCGCGAGCGGGCCGACCGCGGGGAGGCTGAGCGGGGCAGCGGCGGCAGCAGCGGGG
ACGAGCTCAGGGAGGACGATGAGCCCGTCAAGAAGCGGGGACGCAAGGGCCGGGGCCGGGGT
CCCCCGTCCTCCTCTGACTCCGAGCCCGAGGCCGAGCTGGAGAGAGAGGCCAAGAAATCAGC
GAAGAAGCCGCAGTCCTCAAGCACAGAGCCCGCCAGGAAACCTGGCCAGAAGGAGAAGAGAG
TGCGGCCCGAGGAGAAGCAACAAGCCAAGCCCGTGAAGGTGGAGCGGACCCGGAAGCGGTCC
GAGGGCTTCTCGATGGACAGGAAGGTAGAGAAGAAGAAAGAGCCCTCCGTGGAGGAGAAGCT
GCAGAAGCTGCACAGTGAGATCAAGTTTGCCCTAAAGGTCGACAGCCCGGACGTGAAGAGGT
GCCTGAATGCCCTAGAGGAGCTGGGAACCCTGCAGGTGACCTCTCAGATCCTCCAGAAGAAC
ACAGACGTGGTGGCCACCTTGAAGAAGATTCGCCGTTACAAAGCGAACAAGGACGTAATGGA
GAAGGCAGCAGAAGTCTATACCCGGCTCAAGTCGCGGGTCCTCGGCCCAAAGATCGAGGCGG
TGCAGAAAGTGAACAAGGCTGGGATGGAGAAGGAGAAGGCCGAGGAGAAGCTGGCCGGGGAG
GAGCTGGCCGGGGAGGAGCCCCCAGGAGAAGGCGGAGGACAAGCCCAGCACCGATCTCTC
AGCCCCAGTGAATGGCGAGGCCACATCACAGAAGGGGAGAGCGCAGAGGACAAGGAGCACG
AGGAGGGTCGGGACTCGGAGGAGGGCCAAGGTGTGGCTCCTCTGAAGACCTGCACGACAGC
GTACGGGAGGTCCCGACCTGGACAGGCCTGGGAGCGACCGGCAGGAGCGCGAGAGGGCACG
GGGGGACTCGGAGGCCCTGGACGAGGAGAGCTGAGCCGCGGGCAGCCAGGCCCAGCCCCGC
CCGAGCTCAGGCTGCCCCTCTCCTTCCCCGGCTCGCAGGAGAGCAGAGCAGAGAACTGTGGG
GAACGCTGTGCTGTTTGTATTTGTTCCCTTGGGTTTTTTTTTCCTGCCTAATTTCTGTGATT
TCCAACCAACATGAAATGACTATAAACGGTTTTTAATGA

FIGURE 174

></usr/seqdb2/sst/DNA/Dnaseqs.min/ss.DNA71286
><subunit 1 of 1, 671 aa, 1 stop
><MW: 74317, pI: 7.61, NX(S/T): 0
MPHAFKPGDLVFAKMKGYPHWPARIDDIADGAVKPPPNKYPIFFFGTHETAFLGPKDLFPYD
KCKDKYGKPNKRKGFNEGLWEIQNNPHASYSAPPPVSSSDSEAPEANPADGSDADEDDEDRG
VMAVTAVTATAASDRMESDSDSDKSSDNSGLKRKTPALKMSVSKRARKASSDLDQASVSPSE
EENSESSSESEKTSDQDFTPEKKAAVRAPRRGPLGGRKKKKAPSASDSDSKADSDGAKPEPV
AMARSASSSSSSSSSDSDVSVKKPPRGRKPAEKPLPKPRGRKPKPERPPSSSSSDSDSDEV
DRISEWKRRDEARRRELEARRREQEEELRRLREQEKEEKERRRERADRGEAERGSGGSSGD
ELREDDEPVKKRGRKGRGRGPPSSSDSEPEAELEREAKKSAKKPQSSSTEPARKPGQKEKRV
RPEEKQQAKPVKVERTRKRSEGFSMDRKVEKKKEPSVEEKLQKLHSEIKFALKVDSPDVKRC
LNALEELGTLQVTSQILQKNTDVVATLKKIRRYKANKDVMEKAAEVYTRLKSRVLGPKIEAV
QKVNKAGMEKEKAEEKLAGEELAGEEAPQEKAEDKPSTDLSAPVNGEATSQKGESAEDKEHE
EGRDSEEGPRCGSSEDLHDSVREGPDLDRPGSDRQERERARGDSEALDEES

Signal peptide:
amino acids 1-13

FIGURE 175

```
GTTGGTTCTCCTGGATCTTCACCTTACCAACTGCAGATCTTGGGACTCATCAGCCTCAATAATTATATTAAATTA
ACACCATTTGAAAGAGAACATTGTTTTCATCATGAATGCTAATAAAGATGAAAGACTTAAAGCCAGAAGCCAAGA
TTTTCACCTTTTTCCTGCTTTGATGATGCTAAGCATGACCATGTTGTTTCTTCCAGTCACTGGCACTTTGAAGCA
AAATATTCCAAGACTCAAGCTAACCTACAAAGACTTGCTGCTTTCAAATAGCTGTATTCCCTTTTTGGGTTCATC
AGAAGGACTGGATTTTCAAACTCTTCTCTTAGATGAGGAAAGAGGCAGGCTGCTCTTGGGAGCCAAAGACCACAT
CTTTCTACTCAGTCTGGTTGACTTAAACAAAAATTTTAAGAAGATTTATTGGCCTGCTGCAAAGGAACGGGTGGA
ATTATGTAAATTAGCTGGGAAAGATGCCAATACAGAATGTGCAAATTTCATCAGAGTACTTCAGCCCTATAACAA
AACTCACATATATGTGTGTGGAACTGGAGCATTTCATCCAATGTGGGTATATTGATCTTGGAGTCTACAAGGA
GGATATTATATTCAAACTAGACACACATAATTTGGAGTCTGGCAGACTGAAATGTCCTTTCGATCCTCAGCAGCC
TTTTGCTTCAGTAATGACAGATGAGTACCTCTACTCTGGAACAGCTTCTGATTTCCTTGGCAAAGATACTGCATT
CACTCGATCCCTTGGGCCTACTCATGACCACCACTACATCAGAACTGACATTTCAGAGCACTACTGGCTCAATGG
AGCAAAATTTATTGGAACTTTCTTCATACCAGACACCTACAATCCAGATGATGATAAAATATATTTCTTCTTTCG
TGAATCATCTCAAGAAGGCAGTACCTCCGATAAAACCATCCTTTCTCGAGTTGGAAGAGTTTGTAAGAATGATGT
AGGAGGACAACGCAGCCTGATAAACAAGTGGACGACTTTTCTTAAGGCCAGACTGATTTGCTCAATTCCTGGAAG
TGATGGGGCAGATACTTACTTTGATGAGCTTCAAGATATTTATTTACTCCCCACAAGAGATGAAAGAAATCCTGT
AGTATATGGAGTCTTTACTACAACCAGCTCCATCTCAAAGGCTCTGCTGTTTGTGTGTATAGCATGGCTGACAT
CAGAGCAGTTTTTAATGGTCCATATGCTCATAAGGAAAGTGCAGACCATCGTTGGGTGCAGTATGATGGGAGAAT
TCCTTATCCACGGCCTGGTACATGTCCAAGCAAAACCTATGACCCACTGATTAAGTCCACCCGAGATTTTCCAGA
TGATGTCATCAGTTTCATAAAGCGGCACTCTGTGATGTATAAGTCCGTATACCCAGTTGCAGGAGGACCAACGTT
CAAGAGAATCAATGTGGATTACAGACTGACACAGATAGTGGTGGATCATGTCATTGCAGAAGATGGCCAGTACGA
TGTAATGTTTCTTGGAACAGACATTGGAACTGTCCTCAAAGTTGTCAGCATTTCAAAGGAAAAGTGGAATATGGA
AGAGGTAGTGCTGGAGGAGTTGCAGATATTCAAGCACTCATCAATCATCTTGAACATGGAATTGTCTCTGAAGCA
GCAACAATTGTACATTGGTTCCCGAGATGGATTAGTTCAGCTCTCCTTGCACAGATGCGACACTTATTGGGAAGC
TTGCGCAGACTGTTGTCTTGCCAGAGACCCCTACTGTGCCTGGGATGGAAATGCATGCTCTCGATATGCTCCTAC
TTCTAAAAGGAGAGCTAGACGCCAAGATGTAAAATATGGCGACCCAATCACCCAGTGCTGGGACATCGAAGACAG
CATTAGTCATGAAACTGCTGATGAAAAGGTGATTTTGGCATTGAATTTAACTCAACCTTTCTGGAATGTATACC
TAAATCCCAACAAGCAACTATTAAATGGTATATCCAGAGGTCAGGGGATGAGCATCGAGAGGAGTTGAAGCCCGA
TGAAAGAATCATCAAAACGGAATATGGGCTACTGATTCGAAGTTTGCAGAAGAAGGATTCTGGGATGTATTACTG
CAAAGCCCAGGAGCACACTTTCATCCACACCATAGTGAAGCTGACTTTGAATGTCATTGAGAATGAACAGATGGA
AAATACCCAGAGGGCAGAGCATGAGGAGGGGCAGGTCAAGGATCTATTGGCTGAGTCACGGTTGAGATACAAGA
CTACATCCAAATCCTTAGCAGCCCAAACTTCAGCCTCGACCAGTACTGCGAACAGATGTGGCACAGGGAGAAGCG
GAGACAGAGAAACAAGGGGGGCCCAAAGTGGAAGCACATGCAGGAAATGAAGAAGAAACGAAATCGAAGACATCA
CAGAGACCTGGATGAGCTCCCTAGAGCTGTAGCCACGTAGTTTTCTACTTAATTTAAAGAAAAGAATTCCTTACC
TATAAAAACATTGCCTTCTGTTTTGTATATCCCTTATAGTAATTCATAAATGCTTCCCATGGAGTTTTGCTAAGG
CACAAGACAATAATCTGAATAAGACAATATGTGATGAATATAAGAAAGGGCAAAAAATTCATTTGAACCAGTTTT
CCAAGAACAAATCTTGCACAAGCAAAGTATAAGAATTATCCTAAAAATAGGGGGTTTACAGTTGTAAATGTTTTA
TGTTTTGAGTTTTGGAATTTATTGTCATGTAAATAGTTGAGCTAAGCAAGCCCCGAATTTGATAGTGTATAAGGT
GCTTTATTCCCTCGAATGTCCATTAAGCATGGAATTTACCATGCAGTTGTGCTATGTTCTTATGAACAGATATAT
CATTCCTATTGAGAACCAGCTACCTTGTGGTAGGGAATAAGAGGTCAGACACAAATTAAGACAACTCCCATTATC
AACAGGAACTTTCTCAGTGAGCCATTCACTCCTGGAGAATGGTATAGGAATTTGGAGAGGTGCATTATTTCTTTC
TGGCCACTGGGGTTAAATTTAGTGTACTACAACATTGATTACTGAAGGGCACTAATGTTTCCCCCAGGATTTCT
ATTGACTAGTCAGGAGTAACAGGTTCACAGAGAGAAGTTGGTGCTTAGTTATGTGTTTTTAGAGTATATACTAA
GCTCTACAGGGACAGAATGCTTAATAAATACTTTAATAAGATATGGGAAAATATTTTAATAAAACAAGGAAAACA
TAATGATGTATAATGCATCCTGATGGGAAGGCATGCAGATGGGATTTGTTAGAAGACAGAAGGAAAGACAGCCAT
AAATTCTGGCTTTGGGGAAAACTCATATCCCCATGAAAAGGAAGACAATCACAAATAAAGTGAGAGTAATGTAA
TGGAGCTCTTTTCACTAGGGTATAAGTAGCTGCCAATTTGTAATTCATCTGTTAAAAAAAATCTAGATTATAACA
AACTGCTAGCAAAATCTGAGGAAACATAAATTCTTCTGAAGAATCATAGGAAGAGTAGACATTTTATTTATAACC
AATGATATTTCAGTATATATTTTCTCTCTTTTAAAAAATATTTATCATACTCTGTATATTATTTCTTTTTACTGC
CTTTATTCTCTCCTGTATATTGGATTTTGTGATTATATTTGAGTGAATAGGAGAAAACAATATATAACACACAGA
GAATTAAGAAAATGACATTTCTGGGGAGTGGGGATATATATTTGTTGAATAACAGAACGAGTGTAAAATTTTAAC
AACGGAAAGGGTTAAATTAACTCTTTGACATCTTCACTCAACCTTTTCTCATTGCTGAGTTAATCTGTTGTAATT
GTAGTATTGTTTTTGTAATTTAACAATAAATAAGCCTGCTACATGT
```

FIGURE 176

></usr/seqdb2/sst/DNA/Dnaseqs.min/ss.DNA71883
><subunit 1 of 1, 777 aa, 1 stop
><MW: 89651, pI: 7.97, NX(S/T): 3
MNANKDERLKARSQDFHLFPALMMLSMTMLFLPVTGTLKQNIPRLKLTYKDLLLSNSCIPFL
GSSEGLDFQTLLLDEERGRLLLGAKDHIFLLSLVDLNKNFKKIYWPAAKERVELCKLAGKDA
NTECANFIRVLQPYNKTHIYVCGTGAFHPICGYIDLGVYKEDIIFKLDTHNLESGRLKCPFD
PQQPFASVMTDEYLYSGTASDFLGKDTAFTRSLGPTHDHHYIRTDISEHYWLNGAKFIGTFF
IPDTYNPDDDKIYFFFRESSQEGSTSDKTILSRVGRVCKNDVGGQRSLINKWTTFLKARLIC
SIPGSDGADTYFDELQDIYLLPTRDERNPVVYGVFTTTSSIFKGSAVCVYSMADIRAVFNGP
YAHKESADHRWVQYDGRIPYPRPGTCPSKTYDPLIKSTRDFPDDVISFIKRHSVMYKSVYPV
AGGPTFKRINVDYRLTQIVVDHVIAEDGQYDVMFLGTDIGTVLKVVSISKEKWNMEEVVLEE
LQIFKHSSIILNMELSLKQQQLYIGSRDGLVQLSLHRCDTYGKACADCCLARDPYCAWDGNA
CSRYAPTSKRRARRQDVKYGDPITQCWDIEDSISHETADEKVIFGIEFNSTFLECIPKSQQA
TIKWYIQRSGDEHREELKPDERIIKTEYGLLIRSLQKKDSGMYYCKAQEHTFIHTIVKLTLN
VIENEQMENTQRAEHEEGQVKDLLAESRLRYKDYIQILSSPNFSLDQYCEQMWHREKRRQRN
KGGPKWKHMQEMKKKRNRRHHRDLDELPRAVAT

Important features of the protein:
Signal peptide:
amino acids 1-36

N-glycosylation sites.
amino acids 139-142, 607-610, 724-727

Tyrosine kinase phosphorylation site.
amino acids 571-576

Gram-positive cocci surface proteins 'anchoring' hexapeptide.
amino acids 32-37

FIGURE 177

```
CCCTGACCTCCCTGAGCCACACTGAGCTGGAAGCCGCAGAGGTCATCCTGGAGCATGCCCACCGCGGGGAGCAGA
CAACCTCCCAGGTAAGCTGGGAGCAAGACCTGAAGCTGTTTCTTCAGGAGCCTGGTGTATTTTCCCCCACCCCAC
CTCAGCAGTTTCAGCCAGCAGGGACTGATCAGGTGTGTGTCCTGGAGTGGGGAGCAGAAGGCGTGGCTGGCAAGA
GTGGCCTGGAGAAAGAGGTTCAGCGCTTGACCAGCCGAGCTGCCCGTGACTACAAGATCCAGAACCATGGGCATC
GGGTGAGGTGGGGGGGCACAGGTGTCATGTGCACCTTCTTGTCTCAGCAAGAAGAGCTGAGAGAGGGGATCTTGG
AGCCATTGAGGGTGTCATGGAGCTACAGAGGGGAGGGAAAGGTATTTTAAGGTAACAGTGTGGCACAATAGTTAA
GAGCACAGTTTTTGGAGCTAGACCGACATAGGTTCAAATTCTCTTCTGTTGCTTCCTAGTTCTGTAGCCCCAGGT
AAGGGAGTGACTTAACCTCTCTGGACTTCAATTTCCTCATCACTAAAGTAGGGCCAATAATAGCACCCACCTCAT
AGGGAAGATTAAATGACATAATGTATGTGATGCAACTAGCAAAGTACCAGTCCCATAGTAAGTCATGCCCCACAG
TATTTCCACCCACCCCTGTTCTCTGCCTTCCCAACCAGGTACTGCAACGACTGGAGCAGAGGCGGCAGCAGGCTT
CAGAGCGGGAGGCTCCAAGCATAGAACAGAGGTTACAGGAAGTGCGAGAGAGCATCCGCCGGGCACAGGTGAGCC
AGGTGAAGGGGGCTGCCCGGCTGGCCCTGCTGCAGGGGGCTGGCTTAGATGTGGAGCGCTGGCTGAAGCCAGCCA
TGACCCAGGCCCAGGATGAGGTGGAGCAGGAGCGGCGGCTCAGTGAGGCTCGGCTGTCCCAGAGGGACCTCTCTC
CAACCGCTGAGGATGCTGAGCTTTCTGACTTTGAGGAATGTGAGGAGACGGGAGAGCTCTTTGAGGAGCCTGCCC
CCCAAGCCCTGGCCACGAGGGCCCTCCCCTGCCCTGCACACGTGGTATTTCGCTATCAGGCAGGGCGTGAGGATG
AGCTGACAATCACGGAGGGTGAGTGGCTGGAGGTCATAGAGGAGGGAGATGCTGACGAATGGGTCAAGGCTCGGA
ACCAGCACGGCGAGGTAGGCTTTGTCCCTGAGCGATATCTCAACTTCCCGGACCTCTCCCTCCCAGAGAGCAGCC
AAGACAGTGACAATCCCTGCGGGGCAGAGCCCACAGCATTCCTGGCACAGGCCCTGTACAGCTACACCGGACAGA
GTGCAGAGGAGCTGAGCTTCCCTGAGGGGGCACTCATCCGTCTGCTGCCCCGGGCCCAAGATGGAGTAGATGACG
GCTTCTGGAGGGGAGAATTTGGGGGCCGTGTTGGGGTCTTCCCCTCCCTGCTGGTGGAAGAGCTGCTTGGCCCCC
CAGGGCCACCTGAACTCTCTGACCCTGAACAGATGCTGCCGTCCCCTTCTCCTCCCAGCTTCTCCCCACCTGCAC
CTACCTCTGTGTTGGATGGGCCCCCTGCACCTGTCCTGCCTGGGGACAAAGCCCTGGACTTCCCTGGGTTCCTGG
ACATGATGGCACCTCGACTCAGGCCGATGCGTCCACCACCTCCCCCGCCGGCTAAAGCCCCGGATCCTGGCCACC
CAGATCCCCTCACCTGAAGGCCAGGGAAGCCTTGACCCCCAGTGATGCTGCTGTCCCTATCTTCAAGCTGTCAGA
CCACACCATCAATGATCCAGAGCAACACAGCCAAAAGCTGGAATCGCCCTTATTTCCACCCTCACCTCCAAGGGT
GGAAACTTGCCCCTTCCCATTTCTAGAGCTGGAACCCACTCCTTTTTTTCCCATTGTTCTATCATCTCTAGGACC
GGAACTACTACCTTCTCTTCTGTCATGACCCTATCTAGGGTGGTGAAATGCCTGAAATCTCTGGGGCTGGAAACC
ATCCATCAAGGTCTCTAGTAGTTCTGGCCCACCTCTTTCCCCACCCTGGCTCCATGACCCACCCCCACTCTGGATG
CCAGGGTCACTGGGGTTGGGCTGGGGAGAGGAACAGGCCTTGGGAATCAGGAGCTGGAGCCAGGATGCGAAGCAG
CTGTAATGGTCTGAGCGGATTTATTGACAATGAATAAAGGGCACGAAGGCCAGGCCAGGGCCTGGGCCTCTTGTG
CTAAGAGGGCAGGGGGCCTACGGTGCTATTGCTTTAGGGGCCCACCACGGGCAGGGGCCTGCTCCCAGCTGCCAC
GCTCTATCATATGGAGCGAGGTGTTGGGGAAGGCGGGGCAGGCAGCCTGTTGCAGGCAGGGGAAGGAGAAGAGAC
TGAGGGGCTGTGACCTCTCCTGAGGCCCCCAGCCTGAGACTGTGCAACTCCAGGTGGAAGTAGAGCTGGTCCCTC
AGCTGGGGGGCAGTGCTGTCCAGTGGAGGGGAGGGCTTTCACGCCCACCCACCCCCTGGCCCTGCCAGCTGGTAG
TCCATCAGCACAATGAAGGAGACTTGGAGAAGAGGAAGAATAACACTGTTGCTTCCTGTTCAAGCTGTGTCCAGC
TTTTCCCCTGGGGCTCCAGGACCTTCCCTACCTCCACCACCAAACCAAGGGATTTATAGCAAAGGCTAAGCCTGC
AGTTTACTCTGGGGGTTCAGGGAGCCGAAAGGCTTAAATAGTTTAAGTAGGTGATGGGAAGATGAGATTACCTCA
TTTAGGGCTCAGGCAGACTCACCTCACATACTCCCTGCTCCCTGTGGTAGAGACACCTGAGAGAAAGGGGAGGGG
TCAACAATGAGAGACCAGGAGTAGGTCCTATCAGTGCCCCCAGAGTAGAGAGCAATAAGAGCCCAGCCCAGTGC
AGTCCCGGCTGTGTTTCCTACCTGGTGATCAGAAGTGTCTGGTTTGCTTGGCTGCCCATTTGCCTCTTGAGTGG
GCAGCCCTGGGCTTGGCCCCTCCCTCCGGCCCTCAGTGTTGGCTCTGCAGAAGCTCTGGGGTTCCTTCAAGTG
CACGAGGGGTTAGGCTGCTGTCCCTGAGTCCTCCATTCTGTACTGGGGGGCTGGCTAGGACCTGGGGCTGTGGCC
TCTCAGGGGGCAGCCTCTCCATGGCAGGCATCCCTGCCTTGGGCTGCCCTCCCCCAGACCCCTGACCACCCCCTG
GGTCCTGTCCCCCACCAGAGCCCCAGCTCCTGTCTGTGGGGGAGCCATCACGGTGTTCGTGCAGTCCATAGCGCT
TCTCAATGTGTGTCACCCGGAACCTGGGAGGGGAGGGAACACTGGGGTTTAGGACCACAACTCAGAGGCTGCTTG
GCCCTCCCCTCTGACCAGGGACATCCTGAGTTTGGTGGCTACTTCCCTCTGGCCTAAGGTAGGGGAGGCCTTCTC
AGATTGTGGGCACATTGTGTAGCCTGACTTCTGCTGGAGCTCCCAGTCCAGGAGGAAAGAGCCAAGGCCCACTT
TTGGGATCAGGTGCCTGATCACTGGGCCCCTACCTCAGCCCCCTTTCCCTGGAGCACCTGCCCCACCTGCCCA
CAGAGAACACAGTGGTCTCCCCTGTCCGGGGGCGGCTTTTTCCTTCCTTGGAGCGTCCCTGACGGACAAGTGGAG
GCCTCTTGCTGCGGCTGCAATGGATGCAAGGGGCTGCAGAGCCCAGGTGCACTGTGTGATGATGGGAGGGGCTC
CGTCCTGCAGGCTGGAGGTGGCATCCACACTGGACAGCAGGAGGAGGGGAGTGAGGGTAACATTTCCATTTCCCT
TCATGTTTTGTTTCTTACGTTCTTTCAGCATGCTCCTTAAAACCCCAGAAGCCCCAATTTCCCCAAGCCCCATTT
TTTCTTGTCTTTATCTAATAAACTCAATATTAAG
```

FIGURE 178

```
></usr/seqdb2/sst/DNA/Dnaseqs.min/ss.DNA73401
><subunit 1 of 1, 370 aa, 1 stop
><MW: 40685, pI: 4.53, NX(S/T): 0
MQLAKYQSHSKSCPTVFPPTPVLCLPNQVLQRLEQRRQQASEREAPSIEQRLQEVRESIRRA
QVSQVKGAARLALLQGAGLDVERWLKPAMTQAQDEVEQERRLSEARLSQRDLSPTAEDAELS
DFEECEETGELFEEPAPQALATRALPCPAHVVFRYQAGREDELTITEGEWLEVIEEGDADEW
VKARNQHGEVGFVPERYLNFPDLSLPESSQDSDNPCGAEPTAFLAQALYSYTGQSAEELSFP
EGALIRLLPRAQDGVDDGFWRGEFGGRVGVFPSLLVEELLGPPGPPELSDPEQMLPSPSPPS
FSPPAPTSVLDGPPAPVLPGDKALDFPGFLDMMAPRLRPMRPPPPPAKAPDPGHPDPLT
```

FIGURE 179A

CACAGGGAGACCCACAGACACATATGCACGAGAGAGACAGAGGAGGAAAGAGACAGAGACAAAGGCACAGCGGAA
GAAGGCAGAGACAGGGCAGGCACAGAAGCGGCCCAGACAGAGTCCTACAGAGGGAGGAGGCCAGAGAAGCTGCAGA
AGACACAGGCAGGGAGAGACAAAGATCCAGGAAAGGAGGGCTCAGGAGGAGAGTTTGGAGAAGCCAGACCCCTGG
GCACCTCTCCCAAGCCCAAGGACTAAGTTTTCTCCATTTCCTTTAACGGTCCTCAGCCCTTCTGAAAACTTTGCC
TCTGACCTTGGCAGGAGTCCAAGCCCCCAGGCTACAGAGAGGAGCTTTCCAAAGCTAGGGTGTGGAGGACTTGGT
GCCCTAGACGGCCTCAGTCCCTCCCAGCTGCAGTACCAGTGCCATGTCCCAGACAGGCTCGCATCCCGGGAGGGG
CTTGGCAGGGCGCTGGCTGTGGGGAGCCCAACCCTGCCTCCTGCTCCCCATTGTGCCGCTCTCCTGGCTGGTGTG
GCTGCTTCTGCTACTGCTGGCCTCTCTCCTGCCCTCAGCCCGGCTGGCCAGCCCCCTCCCCCGGGAGGAGGAGAT
CGTGTTTCCAGAGAAGCTCAACGGCAGCGTCCTGCCTGGCTCGGGCGCCCCTGCCAGGCTGTTGTGCCGCTTGCA
GGCCTTTGGGGAGACGCTGCTACTAGAGCTGGAGCAGGACTCCGGTGTGCAGGTCGAGGGGCTGACAGTGCAGTA
CCTGGGCCAGGCGCCTGAGCTGCTGGGTGGAGCAGAGCCTGGCACCTACCTGACTGGCACCATCAATGGAGATCC
GGAGTCGGTGGCATCTCTGCACTGGGATGGGGGAGCCCTGTTAGGCGTGTTACAATATCGGGGGCTGAACTCCA
CCTCCAGCCCCTGGAGGGAGGCACCCCTAACTCTGCTGGGGACCTGGGGCTCACATCCTACGCCGGAAGAGTCC
TGCCAGCGGTCAAGGTCCCATGTGCAACGTCAAGGCTCCTCTTGGAAGCCCCAGCCCCAGACCCCGAAGAGCCAA
GCGCTTTGCTTCACTGAGTAGATTTGTGGAGACACTGGTGGTGGCAGATGACAAGATGGCCGCATTCCACGGTGC
GGGGCTAAAGCGCTACCTGCTAACAGTGATGGCAGCAGCAGCCAAGGCCTTCAAGCACCCAAGCATCCGCAATCC
TGTCAGCTTGGTGGTGACTCGGCTAGTGATCCTGGGGTCAGGCGAGGAGGGGCCCCAAGTGGGGCCCAGTGCTGC
CCAGACCCTGCGCAGCTTCTGTGCCTGGCAGCGGGGCCTCAACACCCCTGAGGACTCGGGCCCTGACCACTTTGA
CACAGCCATTCTGTTTACCCGTCAGGACCTGTGTGGAGTCTCCACTTGCGACACGCTGGGTATGGCTGATGTGGG
CACCGTCTGTGACCCGGCTCGGAGCTGTGCCATTGTGGAGGATGATGGGCTCCAGTCAGCCCTTCACTGCTGCTCA
TGAACTGGGTCATGTCTTCAACATGCTCCATGACAACTCCAAGCCATGCATCAGTTTGAATGGGCCTTTGAGCAC
CTCTCGCCATGTCATGGCCCCTGTGATGGCTCATGTGGATCCTGAGGAGCCCTGGTCCCCCTGCAGTGCCCGCTT
CATCACTGACTTCCTGGACAATGGCTATGGGCACTGTCTCTTAGACAAACCAGAGGCTCCATTGCATCTGCCTGT
GACTTTCCCTGGCAAGGACTATGATGCTGACCGCAGTGCCAGCTGACCTTCGGGCCCGACTCACGCCATTGTCC
ACAGCTGCCGCCGCCCTGTGCTGCCCTCTGGTGCTCTGGCCACCTCAATGGCCATGCCATGTGCCAGACCAAACA
CTCGCCCTGGGCCGATGGCACACCCTGCGGGCCCGCACAGGCCTGCATGGGTGGTCGGCTGCCTCCACATGGACCA
GCTCCAGGACTTCAATATTCCACAGGCTGGTGGCTGGGGTCCTTGGGGACCATGGGGTGACTGCTCTCGGACCTG
TGGGGGTGGTGTCCAGTTCTCCTCCCGAGACTGCACGAGGCCTGTCCCCCGGAATGGTGGCAAGTACTGTGAGGG
CCGCCGTACCCGCTTCCGCTCCTGCAACACTGAGGACTGCCCAACTGGCTCAGCCCTGACCTTCCGCGAGGAGCA
GTGTGCTGCCTACAACCACCGCACCGACCTCTTCAAGAGCTTCCCAGGGCCCATGGACTGGGTTCCTCGCTACAC
AGGCGTGGCCCCCCAGGACCAGTGCAAACTCACCTGCCAGGCCCGGGCACTGGGCTACTACTATGTGCTGGAGCC
ACGGGTGGTAGATGGGACCCCCTGTTCCCCGGACAGCTCCTCGGTCTGTGTCAGGGCCGATGCATCCATGCTGG
CTGTGATCGCATCATTGGCTCCAAGAAGAAGTTTGACAAGTGCATGGTGTGCGGAGGGGACGGTTCTGGTTGCAG
CAAGCAGTCAGGCTCCTTCAGGAAATTCAGGTACGGATACAACAATGTGGTCACTATCCCCGCGGGGCCACCCA
CATTCTTGTCCGGCAGCAGGGAAACCCTGGCCACCGGAGCATCTACTTGGCCCTGAAGCTGCCAGATGGCTCCTA
TGCCCTCAATGGTGAATACACGCTGATGCCCTCCCCCACAGATGTGGTACTGCCTGGGGCAGTCAGCTTGCGCTA
CAGCGGGGCCACTGCAGCCTCAGAGACACTGTCAGGCCATGGGCCACTGGCCCAGCCTTTGACACTGCAAGTCCT
AGTGGCTGGCAACCCCCAGGACACACAGCGCTCCGATACAGCTTCTTCGTGCCCCGGCCGACCCCCTTCAACGCCACG
CCCCACTCCCCAGGACTGGCTGCACCGAAGAGCACAGATTCTGGAGATCCTTCGGCGGCGCCCCTGGGCGGCAG
GAAATAACCTCACTATCCCGGCTGCCCTTTCTGGGCACCGGGGCCTCGGACTTAGCTGGGAGAAAGAGAGAGCTT
CTGTTGCTGCCTCATGCTAAGACTCAGTGGGGAGGGGCTGTGGGCGTGAGACCTGCCCCTCCTCTCTGCCCTAAT
GCGCAGGCTGGCCCTGCCCTGGTTTCCTGCCCTGGGAGGCAGTGATGGGTTAGTGGATGGAAGGGGCTGACAGAC
AGCCCTCCATCTAAACTGCCCCCTCTGCCCTGCGGGTCACAGGAGGGAGGGGGAAGGCAGGGAGGGCCTGGGCCC
CAGTTGTATTTATTTAGTATTTATTCACTTTTATTTAGCACCAGGGAAGGGGACAAGGACTAGGGTCCTGGGGAA
CCTGACCCCTGACCCCTCATAGCCCTCACCCTGGGGCTAGGAAATCCAGGGTGGTGGTGATAGGTATAAGTGGTG
TGTGTATGCGTGTGTGTGTGTGTGTGAAAATGTGTGTGTGCTTATGTATGAGGTACAACCTGTTCTGCTTTCCTC
TTCCTGAATTTATTTTTTGGGAAAAGAAAAGTCAAGGGTAGGGTGGGCCTTCAGGGAGTGAGGGATTATCTTTT
TTTTTTTTTCTTTCTTTCTTTCTTTTTTTTTTTTGAGACAGAATCTCGCTCTGTCGCCCAGGCTGGAGTGCAATG
GCACAATCTCGGCTCACTGCATCCTCCGCCTCCCGGGTTCAAGTGATTCTCATGCCTCAGCCTCCTGAGTAGCTG
GGATTACAGGCTCCTGCCACCACGCCCAGCTAATTTTTGTTTTGTTTTGTTTGGAGACAGAGTCTCGCTATTGTC
ACCAGGGCTGGAATGATTTCAGCTCACTGCAACCTTCGCCACCTGGGTTCCAGCAATTCTCCTGCCTCAGCCTCC
CGAGTAGCTGAGATTATAGGCACCTACCACCACGCCCGGCTAATTTTGTATTTTTAGTAGAGACGGGGTTTCAC
CATGTTGGCCAGGCTGGTCTCGAACTCCTGACCTTAGGTGATCCACTCGCCTTCATCTCCCAAAGTGCTGGGATT
ACAGGCGTGAGCCACCGTGCCTGGCCACGCCCAACTAATTTTTGTATTTTTAGTAGAGACAGGGTTTCACCATGT
TGGCCAGGCTGCTCTTGAACTCCTGACCTCAGGTAATCGACCTGCCTCGGCCTCCCAAAGTGCTGGGATTACAGG
TGTGAGCCACCACGCCCGGTACATATTTTTTAAATTGAATTCTACTATTTATGTGATCCTTTTGGAGTCAGACAG

FIGURE 179B

```
ATGTGGTTGCATCCTAACTCCATGTCTCTGAGCATTAGATTTCTCATTTGCCAATAATAATACCTCCCTTAGAAG
TTTGTTGTGAGGATTAAATAATGTAAATAAAGAACTAGCATAACACTCAAAAAAAAAAAAAAAAAAAAAAAAAAA
AAAAAAAAAAAAAAAAAAAAAAAAAAAAAAAAAAAAAAAAAAAAAAAAAAAAAGGAAA
```

FIGURE 180

>\</usr/seqdb2/sst/DNA/Dnaseqs.min/ss.DNA73492
><subunit 1 of 1, 837 aa, 1 stop
><MW: 90167, pI: 8.39, NX(S/T): 1

MSQTGSHPGRGLAGRWLWGAQPCLLLPIVPLSWLVWLLLLLLASLLPSARLASPLPREEEIV
FPEKLNGSVLPGSGAPARLLCRLQAFGETLLLELEQDSGVQVEGLTVQYLGQAPELLGGAEP
GTYLTGTINGDPESVASLHWDGGALLGVLQYRGAELHLQPLEGGTPNSAGGPGAHILRRKSP
ASGQGPMCNVKAPLGSPSPRPRRAKRFASLSRFVETLVVADDKMAAFHGAGLKRYLLTVMAA
AAKAFKHPSIRNPVSLVVTRLVILGSGEEGPQVGPSAAQTLRSFCAWQRGLNTPEDSGPDHF
DTAILFTRQDLCGVSTCDTLGMADVGTVCDPARSCAIVEDDGLQSAFTAAHELGHVFNMLHD
NSKPCISLNGPLSTSRHVMAPVMAHVDPEEPWSPCSARFITDFLDNGYGHCLLDKPEAPLHL
PVTFPGKDYDADRQCQLTFGPDSRHCPQLPPPCAALWCSGHLNGHAMCQTKHSPWADGTPCG
PAQACMGGRCLHMDQLQDFNIPQAGGWGPWGPWGDCSRTCGGGVQFSSRDCTRPVPRNGGKY
CEGRRTRFRSCNTEDCPTGSALTFREEQCAAYNHRTDLFKSFPGPMDWVPRYTGVAPQDQCK
LTCQARALGYYYVLEPRVVDGTPCSPDSSSVCVQGRCIHAGCDRIIGSKKKFDKCMVCGGDG
SGCSKQSGSFRKFRYGYNNVVTIPAGATHILVRQQGNPGHRSIYLALKLPDGSYALNGEYTL
MPSPTDVVLPGAVSLRYSGATAASETLSGHGPLAQPLTLQVLVAGNPQDTRLRYSFFVPRPT
PSTPRPTPQDWLHRRAQILEILRRRPWAGRK

Important features of the protein:

Signal peptide:

amino acids 1-48

N-glycosylation site.

amino acids 68-71

Glycosaminoglycan attachment site amino acids 188-191, 772-775 cAMP- and cGMP-dependent protein kinase phosphorylation site.

amino acids 182-185

Tyrosine kinase phosphorylation site.

amino acids 730-736

N-myristoylation sites.

amino acids 5-10, 19-24, 121-126, 125-130, 130-135, 147-152, 167-172, 168-173, 174-179, 323-328, 352-357, 539-544, 555-560, 577-582, 679-684, 682-687, 763-768

Amidation sites.

amino acids 560-563, 834-837

Leucine zipper pattern.

amino acids 17-38, 24-45

Neutral zinc metallopeptidases, zinc-binding region signature.

amino acids 358-367

FIGURE 181

CAGCAGTGGTCTCTCAGTCCTCTCAAAGCAAGGAAAGAGTACTGTGTGCTGAGAGACCATGG
CAAAGAATCCTCCAGAGAATTGTGAAGACTGTCACATTCTAAATGCAGAAGCTTTTAAATCC
AAGAAAATATGTAAATCACTTAAGATTTGTGGACTGGTGTTTGGTATCCTGGCCCTAACTCT
AATTGTCCTGTTTTGGGGGAGCAAGCACTTCTGGCCGGAGGTACCCAAAAAAGCCTATGACA
TGGAGCACACTTTCTACAGCAATGGAGAGAAGAAGAAGATTTACATGGAAATTGATCCTGTG
ACCAGAACTGAAATATTCAGAAGCGGAAATGGCACTGATGAAACATTGGAAGTGCACGACTT
TAAAAACGGATACACTGGCATCTACTTCGTGGGTCTTCAAAAATGTTTTATCAAAACTCAGA
TTAAAGTGATTCCTGAATTTTCTGAACCAGAAGAGGAAATAGATGAGAATGAAGAAATTACC
ACAACTTTCTTTGAACAGTCAGTGATTTGGGTCCCAGCAGAAAAGCCTATTGAAAACCGAGA
TTTTCTTAAAAATTCCAAAATTCTGGAGATTTGTGATAACGTGACCATGTATTGGATCAATC
CCACTCTAATATCAGTTTCTGAGTTACAAGACTTTGAGGAGGAGGGAGAAGATCTTCACTTT
CCTGCCAACGAAAAAAAAGGGATTGAACAAAATGAACAGTGGGTGGTCCCTCAAGTGAAAGT
AGAGAAGACCCGTCACGCCAGACAAGCAAGTGAGGAAGAACTTCCAATAAATGACTATACTG
AAAATGGAATAGAATTTGATCCCATGCTGGATGAGAGAGGTTATTGTTGTATTTACTGCCGT
CGAGGCAACCGCTATTGCCGCCGCGTCTGTGAACCTTTACTAGGCTACTACCCATATCCATA
CTGCTACCAAGGAGGACGAGTCATCTGTCGTGTCATCATGCCTTGTAACTGGTGGGTGGCCC
GCATGCTGGGGAGGGTCTAATAGGAGGTTTGAGCTCAAATGCTTAAACTGCTGGCAACATAT
AATAAATGCATGCTATTCAATGAATTTCTGCCTATGAGGCATCTGGCCCCTGGTAGCCAGCT
CTCCAGAATTACTTGTAGGTAATTCCTCTCTTCATGTTCTAATAAACTTCTACATTATCACC
AAAAAAAAAAAAAAAAAA

FIGURE 182

></usr/seqdb2/sst/DNA/Dnaseqs.min/ss.DNA73727
><subunit 1 of 1, 317 aa, 1 stop
><MW: 37130, pI: 5.18, NX(S/T): 3
MAKNPPENCEDCHILNAEAFKSKKICKSLKICGLVFGILALTLIVLFWGSKHFWPEVPKKAY
DMEHTFYSNGEKKKIYMEIDPVTRTEIFRSGNGTDETLEVHDFKNGYTGIYFVGLQKCFIKT
QIKVIPEFSEPEEEIDENEEITTTFFEQSVIWVPAEKPIENRDFLKNSKILEICDNVTMYWI
NPTLISVSELQDFEEEGEDLHFPANEKKGIEQNEQWVVPQVKVEKTRHARQASEEELPINDY
TENGIEFDPMLDERGYCCIYCRRGNRYCRRVCEPLLGYYPYPYCYQGGRVICRVIMPCNWWV
ARMLGRV Important features of the protein:
Signal peptide:
amino acids 1-40

Transmembrane domain:
amino acids 25-47 (type II)

N-glycosylation sites.
amino acids 94-97, 180-183

Glycosaminoglycan attachment sites.
amino acids 92-95, 70-73, 85-88, 133-136, 148-151, 192-195, 239-242

N-myristoylation sites.
amino acids 33-38, 95-100, 116-121, 215-220, 272-277

Microbodies C-terminal targeting signal.
amino acids 315-317

Cytochrome c family heme-binding site signature.
amino acids 9-14

FIGURE 183

GCGGAACTGGCTCCGGCTGGCACCTGAGGAGCGGCGTGACCCCGAGGGCCCAGGGAGCTGCC
CGGCTGGCCTAGGCAGGCAGCCGCACCATGGCCAGCACGGCCGTGCAGCTTCTGGGCTTCCT
GCTCAGCTTCCTGGGCATGGTGGGCACGTTGATCACCACCATCCTGCCGCACTGGCGGAGGA
CAGCGCACGTGGGCACCAACATCCTCACGGCCGTGTCCTACCTGAAAGGGCTCTGGATGGAG
TGTGTGTGGCACAGCACAGGCATCTACCAGTGCCAGATCTACCGATCCCTGCTGGCGCTGCC
CCAAGACCTCCAGGCTGCCCGCGCCCTCATGGTCATCTCCTGCCTGCTCTCGGGCATAGCCT
GCGCCTGCGCCGTCATCGGGATGAAGTGCACGCGCTGCGCCAAGGGCACACCCGCCAAGACC
ACCTTTGCCATCCTCGGCGGCACCCTCTTCATCCTGGCCGGCCTCCTGTGCATGGTGGCCGT
CTCCTGGACCACCAACGACGTGGTGCAGAACTTCTACAACCCGCTGCTGCCCAGCGGCATGA
AGTTTGAGATTGGCCAGGCCCTGTACCTGGGCTTCATCTCCTCGTCCCTCTCGCTCATTGGT
GGCACCCTGCTTTGCCTGTCCTGCCAGGACGAGGCACCCTACAGGCCCTACCAGGCCCCGCC
CAGGGCCACCACGACCACTGCAAACACCGCACCTGCCTACCAGCCACCAGCTGCCTACAAAG
ACAATCGGGCCCCCTCAGTGACCTCGGCCACGCACAGCGGGTACAGGCTGAACGACTACGTG
TGAGTCCCCACAGCCTGCTTCTCCCCTGGGCTGCTGTGGGCTGGGTCCCCGGCGGGACTGTC
AATGGAGGCAGGGGTTCCAGCACAAAGTTTACTTCTGGGCAATTTTTGTATCCAAGGAAATA
ATGTGAATGCGAGGAAATGTCTTTAGAGCACAGGGACAGAGGGGGAAATAAGAGGAGGAGAA
AGCTCTCTATACCAAAGACTGAAAAAAAAAATCCTGTCTGTTTTTGTATTTATTATATATAT
TTATGTGGGTGATTTGATAACAAGTTTAATATAAAGTGACTTGGGAGTTTGGTCAGTGGGGT
TGGTTTGTGATCCAGGAATAAACCTTGCGGATGTGGCTGTTTATGAAAAAAAAAAAAA

FIGURE 184

MASTAVQLLGFLLSFLGMVGTLITTILPHWRRTAHVGTNILTAVSYLKGLWMECVWHSTGIY
QCQIYRSLLALPQDLQAARALMVISCLLSGIACACAVIGMKCTRCAKGTPAKTTFAILGGTL
FILAGLLCMVAVSWTTNDVVQNFYNPLLPSGMKFEIGQALYLGFISSSLSLIGGTLLCLSCQ
DEAPYRPYQAPPRATTTTANTAPAYQPPAAYKDNRAPSVTSATHSGYRLNDYV

Important features of the protein:

Signal peptide:

amino acids 1-21

Transmembrane domains:

amino acids 82-103, 115-141, 160-182

FIGURE 185

GAGCTCCCCTCAGGAGCGCGTTAGCTTCACACCTTCGGCAGCAGGAGGGCGGCAGCTTCTCG
CAGGCGGCAGGGCGGGCGGCCAGGATCATGTCCACCACCACATGCCAAGTGGTGGCGTTCCT
CCTGTCCATCCTGGGGCTGGCCGGCTGCATCGCGGCCACCGGGATGGACATGTGGAGCACCC
AGGACCTGTACGACAACCCCGTCACCTCCGTGTTCCAGTACGAAGGGCTCTGGAGGAGCTGC
GTGAGGCAGAGTTCAGGCTTCACCGAATGCAGGCCCTATTTCACCATCCTGGGACTTCCAGC
CATGCTGCAGGCAGTGCGAGCCCTGATGATCGTAGGCATCGTCCTGGGTGCCATTGGCCTCC
TGGTATCCATCTTTGCCCTGAAATGCATCCGCATTGGCAGCATGGAGGACTCTGCCAAAGCC
AACATGACACTGACCTCCGGGATCATGTTCATTGTCTCAGGTCTTTGTGCAATTGCTGGAGT
GTCTGTGTTTGCCAACATGCTGGTGACTAACTTCTGGATGTCCACAGCTAACATGTACACCG
GCATGGGTGGGATGGTGCAGACTGTTCAGACCAGGTACACATTTGGTGCGGCTCTGTTCGTG
GGCTGGGTCGCTGGAGGCCTCACACTAATTGGGGGTGTGATGATGTGCATCGCCTGCCGGGG
CCTGGCACCAGAAGAAACCAACTACAAAGCCGTTTCTTATCATGCCTCAGGCCACAGTGTTG
CCTACAAGCCTGGAGGCTTCAAGGCCAGCACTGGCTTTGGGTCCAACACCAAAAACAAGAAG
ATATACGATGGAGGTGCCCGCACAGAGGACGAGGTACAATCTTATCCTTCCAAGCACGACTA
TGTGTAATGCTCTAAGACCTCTCAGCACGGGCGGAAGAAACTCCCGGAGAGCTCACCCAAAA
AACAAGGAGATCCCATCTAGATTTCTTCTTGCTTTTGACTCACAGCTGGAAGTTAGAAAAGC
CTCGATTTCATCTTTGGAGAGGCCAAATGGTCTTAGCCTCAGTCTCTGTCTCTAAATATTCC
ACCATAAAACAGCTGAGTTATTTATGAATTAGAGGCTATAGCTCACATTTTCAATCCTCTAT
TTCTTTTTTTAAATATAACTTTCTACTCTGATGAGAGAATGTGGTTTTAATCTCTCTCTCAC
ATTTTGATGATTTAGACAGACTCCCCCTCTTCCTCCTAGTCAATAAACCCATTGATGATCTA
TTTCCCAGCTTATCCCCAAGAAAACTTTTGAAAGGAAAGAGTAGACCCAAAGATGTTATTTT
CTGCTGTTTGAATTTTGTCTCCCCACCCCCAACTTGGCTAGTAATAAACACTTACTGAAGAA
GAAGCAATAAGAGAAAGATATTTGTAATCTCTCCAGCCCATGATCTCGGTTTTCTTACACTG
TGATCTTAAAAGTTACCAAACCAAAGTCATTTTCAGTTTGAGGCAACCAAACCTTTCTACTG
CTGTTGACATCTTCTTATTACAGCAACACCATTCTAGGAGTTTCCTGAGCTCTCCACTGGAG
TCCTCTTTCTGTCGCGGGTCAGAAATTGTCCCTAGATGAATGAGAAATTATTTTTTTTAAT
TTAAGTCCTAAATATAGTTAAAATAAATAATGTTTTAGTAAAATGATACACTATCTCTGTGA
AATAGCCTCACCCCTACATGTGGATAGAAGGAAATGAAAAATAATTGCTTTGACATTGTCT
ATATGGTACTTTGTAAAGTCATGCTTAAGTACAAATTCCATGAAAAGCTCACACCTGTAATC
CTAGCACTTTGGGAGGCTGAGGAGGAAGGATCACTTGAGCCCAGAAGTTCGAGACTAGCCTG
GGCAACATGGAGAAGCCCTGTCTCTACAAAATACAGAGAGAAAAATCAGCCAGTCATGGTG
GCATACACCTGTAGTCCCAGCATTCCGGGAGGCTGAGGTGGGAGGATCACTTGAGCCCAGGG
AGGTTGGGGCTGCAGTGAGCCATGATCACACCACTGCACTCCAGCCAGGTGACATAGCGAGA
TCCTGTCTAAAAAAATAAAAAATAAATAATGGAACACAGCAAGTCCTAGGAAGTAGGTTAAA
ACTAATTCTTTAA

FIGURE 186

></usr/seqdb2/sst/DNA/Dnaseqs.min/ss.DNA73734
><subunit 1 of 1, 261 aa, 1 stop
><MW: 27856, pI: 8.50, NX(S/T): 1
MSTTTCQVVAFLLSILGLAGCIAATGMDMWSTQDLYDNPVTSVFQYEGLWRSCVRQSSGFTE
CRPYFTILGLPAMLQAVRALMIVGIVLGAIGLLVSIFALKCIRIGSMEDSAKANMTLTSGIM
FIVSGLCAIAGVSVFANMLVTNFWMSTANMYTGMGGMVQTVQTRYTFGAALFVGWVAGGLTL
IGGVMMCIACRGLAPEETNYKAVSYHASGHSVAYKPGGFKASTGFGSNTKNKKIYDGGARTE
DEVQSYPSKHDYV

Signal peptide:
amino acids 1-23

Transmembrane domains:
amino acids 81-100, 121-141, 173-194

FIGURE 187

GGAAAAACTGTTCTCTTCTGTGGCACAGAGAACCCTGCTTCAAAGCAGAAGTAGCAGTTCCG
GAGTCCAGCTGGCTAAAACTCATCCCAGAGGATAATGGCAACCCATGCCTTAGAAATCGCTG
GGCTGTTTCTTGGTGGTGTTGGAATGGTGGGCACAGTGGCTGTCACTGTCATGCCTCAGTGG
AGAGTGTCGGCCTTCATTGAAAACAACATCGTGGTTTTTGAAAACTTCTGGGAAGGACTGTG
GATGAATTGCGTGAGGCAGGCTAACATCAGGATGCAGTGCAAAATCTATGATTCCCTGCTGG
CTCTTTCTCCGGACCTACAGGCAGCCAGAGGACTGATGTGTGCTGCTTCCGTGATGTCCTTC
TTGGCTTTCATGATGGCCATCCTTGGCATGAAATGCACCAGGTGCACGGGGACAATGAGAA
GGTGAAGGCTCACATTCTGCTGACGGCTGGAATCATCTTCATCATCACGGGCATGGTGGTGC
TCATCCCTGTGAGCTGGGTTGCCAATGCCATCATCAGAGATTTCTATAACTCAATAGTGAAT
GTTGCCCAAAAACGTGAGCTTGGAGAAGCTCTCTACTTAGGATGGACCACGGCACTGGTGCT
GATTGTTGGAGGAGCTCTGTTCTGCTGCGTTTTTGTTGCAACGAAAAGAGCAGTAGCTACA
GATACTCGATACCTTCCCATCGCACAACCCAAAAAAGTTATCACACCGGAAAGAAGTCACCG
AGCGTCTACTCCAGAAGTCAGTATGTGTAGTTGTGTATGTTTTTTAACTTTACTATAAAGC
CATGCAAATGACAAAAATCTATATTACTTTCTCAAAATGGACCCCAAAGAAACTTTGATTTA
CTGTTCTTAACTGCCTAATCTTAATTACAGGAACTGTGCATCAGCTATTTATGATTCTATAA
GCTATTTCAGCAGAATGAGATATTAAACCCAATGCTTTGATTGTTCTAGAAAGTATAGTAAT
TTGTTTTCTAAGGTGGTTCAAGCATCTACTCTTTTATCATTTACTTCAAAATGACATTGCT
AAAGACTGCATTATTTTACTACTGTAATTTCTCCACGACATAGCATTATGTACATAGATGAG
TGTAACATTTATATCTCACATAGAGACATGCTTATATGGTTTTATTTAAAATGAAATGCCAG
TCCATTACACTGAATAAATAGAACTCAACTATTGCTTTTCAGGGAAATCATGGATAGGGTTG
AAGAAGGTTACTATTAATTGTTTAAAAACAGCTTAGGGATTAATGTCCTCCATTTATAATGA
AGATTAAAATGAAGGCTTTAATCAGCATTGTAAAGGAAATTGAATGGCTTTCTGATATGCTG
TTTTTTAGCCTAGGAGTTAGAAATCCTAACTTCTTTATCCTCTTCTCCCAGAGGCTTTTTTT
TTCTTGTGTATTAAATTAACATTTTTAAAACGCAGATATTTTGTCAAGGGGCTTTGCATTCA
AACTGCTTTTCCAGGGCTATACTCAGAAGAAAGATAAAAGTGTGATCTAAGAAAAAGTGATG
GTTTTAGGAAAGTGAAAATATTTTTGTTTTGTATTTGAAGAAGAATGATGCATTTTGACAA
GAAATCATATATGTATGGATATATTTTAATAAGTATTTGAGTACAGACTTTGAGGTTTCATC
AATATAAATAAAAGAGCAGAAAATATGTCTTGGTTTTCATTTGCTTACCAAAAAAACAACA
ACAAAAAAGTTGTCCTTTGAGAACTTCACCTGCTCCTATGTGGGTACCTGAGTCAAAATTG
TCATTTTTGTTCTGTGAAAAATAAATTTCCTTCTTGTACCATTTCTGTTTAGTTTTACTAAA
ATCTGTAAATACTGTATTTTTCTGTTTATTCCAAATTTGATGAAACTGACAATCCAATTTGA
AAGTTTGTGTCGACGTCTGTCTAGCTTAAATGAATGTGTTCTATTTGCTTTATACATTTATA
TTAATAAATTGTACATTTTTCTAATT

FIGURE 188

></usr/seqdb2/sst/DNA/Dnaseqs.min/ss.DNA73735
><subunit 1 of 1, 225 aa, 1 stop
><MW: 24845, pI: 9.07, NX(S/T): 0

MATHALEIAGLFLGGVGMVGTVAVTVMPQWRVSAFIENNIVVFENFWEGLWMNCVRQANIRM
QCKIYDSLLALSPDLQAARGLMCAASVMSFLAFMMAILGMKCTRCTGDNEKVKAHILLTAGI
IFIITGMVVLIPVSWVANAIIRDFYNSIVNVAQKRELGEALYLGWTTALVLIVGGALFCCVF
CCNEKSSSYRYSIPSHRTTQKSYHTGKKSPSVYSRSQYV

Signal peptide:

amino acids 1-17

Transmembrane domains:

amino acids 82-101, 118-145, 164-188

FIGURE 189

TCGCCATGGCCTCTGCCGGAATGCAGATCCTGGGAGTCGTCCTGACACTGCTGGGCTGGGTG
AATGGCCTGGTCTCCTGTGCCCTGCCCATGTGGAAGGTGACCGCTTTCATCGGCAACAGCAT
CGTGGTGGCCCAGGTGGTGTGGGAGGGCCTGTGGATGTCCTGCGTGGTGCAGAGCACCGGCC
AGATGCAGTGCAAGGTGTACGACTCACTGCTGGCGCTGCCACAGGACCTGCAGGCTGCACGT
GCCCTCTGTGTCATCGCCCTCCTTGTGGCCCTGTTCGGCTTGCTGGTCTACCTTGCTGGGGC
CAAGTGTACCACCTGTGTGGAGGAGAAGGATTCCAAGGCCCGCCTGGTGCTCACCTCTGGGA
TTGTCTTTGTCATCTCAGGGGTCCTGACGCTAATCCCCGTGTGCTGGACGGCGCATGCCATC
ATCCGGGACTTCTATAACCCCCTGGTGGCTGAGGCCCAAAAGCGGGAGCTGGGGGCCTCCCT
CTACTTGGGCTGGGCGGCCTCAGGCCTTTTGTTGCTGGGTGGGGGGTTGCTGTGCTGCACTT
GCCCCTCGGGGGGGTCCCAGGGCCCCAGCCATTACATGGCCCGCTACTCAACATCTGCCCCT
GCCATCTCTCGGGGGCCCTCTGAGTACCCTACCAAGAATTACGTCTGACGTGGAGGGGAATG
GGGGCTCCGCTGGCGCTAGAGCCATCCAGAAGTGGCAGTGCCCAACAGCTTTGGGATGGGTT
CGTACCTTTTGTTTCTGCCTCCTGCTATTTTTCTTTTGACTGAGGATATTTAAAATTCATTT
GAAAACTGAGCCAAGGTGTTGACTCAGACTCTCACTTAGGCTCTGCTGTTTCTCACCCTTGG
ATGATGGAGCCAAAGAGGGGATGCTTTGAGATTCTGGATCTTGACATGCCCATCTTAGAAGC
CAGTCAAGCTATGGAACTAATGCGGAGGCTGCTTGCTGTGCTGGCTTTGCAACAAGACAGAC
TGTCCCCAAGAGTTCCTGCTGCTGCTGGGGGCTGGGCTTCCCTAGATGTCACTGGACAGCTG
CCCCCCATCCTACTCAGGTCTCTGGAGCTCCTCTCTTCACCCCTGGAAAAACAAATCATCTG
TTAACAAAGGACTGCCCACCTCCGGAACTTCTGACCTCTGTTTCCTCCGTCCTGATAAGACG
TCCACCCCCCAGGGCCAGGTCCCAGCTATGTAGACCCCGCCCCCACCTCCAACACTGCACC
CTTCTGCCCTGCCCCCCTCGTCTCACCCCCTTTACACTCACATTTTTATCAAATAAAGCATG
TTTTGTTAGTGCA

FIGURE 190

></usr/seqdb2/sst/DNA/Dnaseqs.min/ss.DNA73736
><subunit 1 of 1, 220 aa, 1 stop
><MW: 23292, pI: 8.43, NX(S/T): 0
MASAGMQILGVVLTLLGWVNGLVSCALPMWKVTAFIGNSIVVAQVVWEGLWMSCVVQSTGQM
QCKVYDSLLALPQDLQAARALCVIALLVALFGLLVYLAGAKCTTCVEEKDSKARLVLTSGIV
FVISGVLTLIPVCWTAHAIIRDFYNPLVAEAQKRELGASLYLGWAASGLLLLGGGLLCCTCP
SGGSQGPSHYMARYSTSAPAISRGPSEYPTKNYV

Transmembrane domains:

amino acids 8-30 (type II), 82-102, 121-140, 166-186

FIGURE 191

GCCAAGGAGAACATCATCAAAGACTTCTCTAGACTCAAAAGGCTTCCACGTTCTACATCTTG
AGCATCTTCTACCACTCCGAATTGAACCAGTCTTCAAAGTAAAGGCAATGGCATTTTATCCC
TTGCAAATTGCTGGGCTGGTTCTTGGGTTCCTTGGCATGGTGGGGACTCTTGCCACAACCCT
TCTGCCTCAGTGGTGGAGTATCAGCTTTTGTTGGCAGCAACATTATTGTCTTTGAGAGGCTC
TGGGAAGGGCTCTGGATGAATTGCATCCGACAAGCCAGGGTCCGGTTGCAATGCAAGTTCTA
TAGCTCCTTGTTGGCTCTCCCGCCTGCCCTGGAAACAGCCCGGGCCCTCATGTGTGTGGCTG
TTGCTCTCTCCTTGATCGCCCTGCTTATTGGCATCTGTGGCATGAAGCAGGTCCAGTGCACA
GGCTCTAACGAGAGGGCCAAAGCATACCTTCTGGGAACTTCAGGAGTCCTCTTCATCCTGAC
GGGTATCTTCGTTCTGATTCCGGTGAGCTGGACAGCCAATATAATCATCAGAGATTTCTACA
ACCCAGCCATCCACATAGGTCAGAAACGAGAGCTGGGAGCAGCACTTTTCCTTGGCTGGGCA
AGCGCTGCTGTCCTCTTCATTGGAGGGGGTCTGCTTTGTGGATTTTGCTGCTGCAACAGAAA
GAAGCAAGGGTACAGATATCCAGTGCCTGGCTACCGTGTGCCACACACAGATAAGCGAAGAA
ATACGACAATGCTTAGTAAGACCTCCACCAGTTATGTCTAATGCCTCCTTTTGGCTCCAAGT
ATGGACTATGGTCAATGTTTTTTATAAAGTCCTGCTAGAAACTGTAAGTATGTGAGGCAGGA
GAACTTGCTTTATGTCTAGATTTACATTGATACGAAAGTTTCAATTTGTTACTGGTGGTAGG
AATGAAAATGACTTACTTGGACATTCTGACTTCAGGTGTATTAAATGCATTGACTATTGTTG
GACCCAATCGCTGCTCCAATTTTCATATTCTAAATTCAAGTATACCCATAATCATTAGCAAG
TGTACAATGATGGACTACTTATTACTTTTTGACCATCATGTATTATCTGATAAGAATCTAAA
GTTGAAATTGATATTCTATAACAATAAACATATACCTATTCTA

FIGURE 192

></usr/seqdb2/sst/DNA/Dnaseqs.min/ss.DNA73737
><subunit 1 of 1, 173 aa, 1 stop
><MW: 18938, pI: 9.99, NX(S/T): 1
MNCIRQARVRLQCKFYSSLLALPPALETARALMCVAVALSLIALLIGICGMKQVQCTGSNER
AKAYLLGTSGVLFILTGIFVLIPVSWTANIIIRDFYNPAIHIGQKRELGAALFLGWASAAVL
FIGGGLLCGFCCCNRKKQGYRYPVPGYRVPHTDKRRNTTMLSKTSTSYV

Important features of the protein:

Transmembrane domains:

amino acids 31-51, 71-90, 112-133

N-glycosylation site.

amino acids 161-164

FIGURE 193

AGTGACAATCTCAGAGCAGCTTCTACACCACAGCCATTTCCAGCATGAAGATCACTGGGGGT
CTCCTTCTGCTCTGTACAGTGGTCTATTTCTGTAGCAGCTCAGAAGCTGCTAGTCTGTCTCC
AAAAAAAGTGGACTGCAGCATTTACAAGAAGTATCCAGTGGTGGCCATCCCCTGCCCCATCA
CATACCTACCAGTTTGTGGTTCTGACTACATCACCTATGGGAATGAATGTCACTTGTGTACC
GAGAGCTTGAAAAGTAATGGAAGAGTTCAGTTTCTTCACGATGGAAGTTGCTAAATTCTCCA
TGGACATAGAGAGAAAGGAATGATATTCTCATCATCATCTTCATCATCCCAGGCTCTGACTG
AGTTTCTTTCAGTTTTACTGATGTTCTGGGTGGGGACAGAGCCAGATTCAGAGTAATCTTG
ACTGAATGGAGAAAGTTTCTGTGCTACCCCTACAAACCCATGCCTCACTGACAGACCAGCAT
TTTTTTTTTAACACGTCAATAAAAAAATAATCTCCAGA

FIGURE 194

```
></usr/seqdb2/sst/DNA/Dnaseqs.min/ss.DNA73739
><subunit 1 of 1, 85 aa, 1 stop
><MW: 9232, pI: 7.94, NX(S/T): 0
MKITGGLLLLCTVVYFCSSSEAASLSPKKVDCSIYKKYPVVAIPCPITYLPVCGSDYITYGN
ECHLCTESLKSNGRVQFLHDGSC
```

Signal peptide:

amino acids 1-19

FIGURE 195

CCCGCGCCCGGTTCTCCCTCGCAGCACCTCGAAGTGCGCCCCTCGCCCTCCTGCTCGCGCCC
CGCCGCCATGGCTGCCTCCCCGCGCGGCCTGCTGTCCTGGCCCTGACCGGGCTGGCGCTGC
TCCTGCTCCTGTGCTGGGGCCCAGGTGGCATAAGTGGAAATAAACTCAAGCTGATGCTTCAA
AAACGAGAAGCACCTGTTCCAACTAAGACTAAAGTGGCCGTTGATGAGAATAAAGCCAAAGA
ATTCCTTGGCAGCCTGAAGCGCCAGAAGCGGCAGCTGTGGGACCGGACTCGGCCCGAGGTGC
AGCAGTGGTACCAGCAGTTTCTCTACATGGGCTTTGATGAAGCGAAATTTGAAGATGACATC
ACCTATTGGCTTAACAGAGATCGAAATGGACATGAATACTATGGCGATTACTACCAACGTCA
CTATGATGAAGACTCTGCAATTGGTCCCCGGAGCCCCTACGGCTTTAGGCATGGAGCCAGCG
TCAACTACGATGACTACTAACCATGACTTGCCACACGCTGTACAAGAAGCAAATAGCGATTC
TCTTCATGTATCTCCTAATGCCTTACACTACTTGGTTTCTGATTTGCTCTATTTCAGCAGAT
CTTTTCTACCTACTTTGTGTGATCAAAAAAGAAGAGTTAAAACAACACATGTAAATGCCTTT
TGATATTTCATGGGAATGCCTCTCATTTAAAAATAGAAATAAAGCATTTTGTTAAAAAGA

FIGURE 196

></usr/seqdb2/sst/DNA/Dnaseqs.min/ss.DNA73742
><subunit 1 of 1, 148 aa, 1 stop
><MW: 17183, pI: 8.77, NX(S/T): 0
MAASPARPAVLALTGLALLLLCWGPGGISGNKLKLMLQKREAPVPTKTKVAVDENKAKEFL
GSLKRQKRQLWDRTRPEVQQWYQQFLYMGFDEAKFEDDITYWLNRDRNGHEYYGDYYQRHYD
EDSAIGPRSPYGFRHGASVNYDDY

Signal peptide:
amino acids 1-30

FIGURE 197

CGGCTCGAGCCCGCCCGGAAGTGCCCGAGGGGCCGCGATGGAGCTGGGGGAGCCGGGCGCTC
GGTAGCGCGGCGGGCAAGGCAGGCGCCATGACCCTGATTGAAGGGGTGGGTGATGAGGTGAC
CGTCCTTTTCTCGGTGCTTGCCTGCCTTCTGGTGCTGGCCCTTGCCTGGGTCTCAACGCACA
CCGCTGAGGGCGGGGACCCACTGCCCCAGCCGTCAGGGACCCCAACGCCATCCCAGCCCAGC
GCAGCCATGGCAGCTACCGACAGCATGAGAGGGGAGGCCCCAGGGGCAGAGACCCCCAGCCT
GAGACACAGAGGTCAAGCTGCACAGCCAGAGCCCAGCACGGGGTTCACAGCAACACCGCCAG
CCCCGGACTCCCCGCAGGAGCCCCTCGTGCTACGGCTGAAATTCCTCAATGATTCAGAGCAG
GTGGCCAGGGCCTGGCCCCACGACACCATTGGCTCCTTGAAAAGGACCCAGTTTCCCGGCCG
GGAACAGCAGGTGCGACTCATCTACCAAGGGCAGCTGCTAGGCGACGACACCCAGACCCTGG
GCAGCCTTCACCTCCCTCCCAACTGCGTTCTCCACTGCCACGTGTCCACGAGAGTCGGTCCC
CCAAATCCCCCCTGCCCGCCGGGGTCCGAGCCCGGCCCCTCCGGGCTGGAAATCGGCAGCCT
GCTGCTGCCCCTGCTGCTCCTGCTGTTGCTGCTGCTCTGGTACTGCCAGATCCAGTACCGGC
CCTTCTTTCCCCTGACCGCCACTCTGGGCCTGGCCGGCTTCACCCTGCTCCTCAGTCTCCTG
GCCTTTGCCATGTACCGCCCGTAGTGCCTCCGCGGGCGCTTGGCAGCGTCGCCGGCCCCTCC
GGACCTTGCTCCCCGCGCCGCGGCGGGAGCTGCTGCCTGCCCAGGCCCGCCTCTCCGGCCTG
CCTCTTCCCGCTGCCCTGGAGCCCAGCCCTGCGCCGCAGAGGACTCCCGGGACTGGCGGAGG
CCCCGCCCTGCGACCGCCGGGGCTCGGGGCCACCTCCCGGGGCTGCTGAACCTCAGCCCGCA
CTGGGAGTGGGCTCCTCGGGGTCGGGCATCTGCTGTCGCTGCCTCGGCCCCGGGCAGAGCCG
GGCCGCCCCGGGGGCCCGTCTTAGTGTTCTGCCGGAGGACCCAGCCGCCTCCAATCCCTGAC
AGCTCCTTGGGCTGAGTTGGGGACGCCAGGTCGGTGGGAGGCTGGTGAAGGGGAGCGGGGAG
GGGCAGAGGAGTTCCCCGGAACCCGTGCAGATTAAAGTAACTGTGAAGTTTTAAAAAAAAA
AAAAAAA

FIGURE 198

MTLIEGVGDEVTVLFSVLACLLVLALAWVSTHTAEGGDPLPQPSGTPTPSQPSAAMAATDSM
RGEAPGAETPSLRHRGQAAQPEPSTGFTATPPAPDSPQEPLVLRLKFLNDSEQVARAWPHDT
IGSLKRTQFPGREQQVRLIYQGQLLGDDTQTLGSLHLPPNCVLHCHVSTRVGPPNPPCPPGS
EPGPSGLEIGSLLLPLLLLLLLLWYCQIQYRPFFPLTATLGLAGFTLLLSLLAFAMYRP

Signal peptide:

amino acids 1-31

Transmembrane domain:

amino acids 195-217

FIGURE 199

GAGATTGGAAACAGCCAGGTTGGAGCAGTGAGTGAGTAAGGAAACCTGGCTGCCCTCTCCAG
ATTCCCCAGGCTCTCAGAGAAGATCAGCAGAAAGTCTGCAAGACCCTAAGAACCATCAGCCC
TCAGCTGCACCTCCTCCCCTCCAAGGATGACAAAGGCGCTACTCATCTATTTGGTCAGCAGC
TTTCTTGCCCTAAATCAGGCCAGCCTCATCAGTCGCTGTGACTTGGCCCAGGTGCTGCAGCT
GGAGGACTTGGATGGGTTTGAGGGTTACTCCCTGAGTGACTGGCTGTGCCTGGCTTTTGTGG
AAAGCAAGTTCAACATATCAAAGATAAATGAAATGCGGATGGAAGCTTTGACTATGGCCTC
TTCCAGATCAACAGCCACTACTGGTGCAACGATTATAAGAGTTACTCGGAAAACCTTTGCCA
CGTAGACTGTCAAGATCTGCTGAATCCCAACCTTCTTGCAGGCATCCACTGCGCAAAAAGGA
TTGTGTCCGGAGCACGGGGGATGAACAACTGGGTAGAATGGAGGTTGCACTGTTCAGGCCGG
CCACTCTCCTACTGGCTGACAGGATGCCGCCTGAGATGAAACAGGGTGCGGGTGCACCGTGG
AGTCATTCCAAGACTCCTGTCCTCACTCAGGGATTCTTCATTTCTTCTTCCTACTGCCTCCA
CTTCATGTTATTTTCTTCCCTTCCCATTTACAACTAAAACTGACCAGAGCCCCAGGAATAAA
TGGTTTTCTTGGCTTCCTCCTTACTCCCATCTGGACCCAGTCCCCTGGTTCCTGTCTGTTAT
TTGTAAACTGAGGACCACAATAAAGAAATCTTTATATTTATCG

FIGURE 200

></usr/seqdb2/sst/DNA/Dnaseqs.min/ss.DNA73746
><subunit 1 of 1, 148 aa, 1 stop
><MW: 16896, pI: 6.05, NX(S/T): 1
MTKALLIYLVSSFLALNQASLISRCDLAQVLQLEDLDGFEGYSLSDWLCLAFVESKFNISKI
NENADGSFDYGLFQINSHYWCNDYKSYSENLCHVDCQDLLNPNLLAGIHCAKRIVSGARGMN
NWVEWRLHCSGRPLSYWLTGCRLR

Signal peptide:

amino acids 1-18

FIGURE 201

```
TCTGACCTGACTGGAAGCGTCCAAAGAGGGACGGCTGTCAGCCCTGCTTGACTGAGAACCCA
CCAGCTCATCCCAGACACCTCATAGCAACCTATTTATACAAAGGGGGAAAGAAACACCTGAG
CAGAATGGAATCATTATTTTTTTCCCAAGGAGAAAACCGGGGTAAAGGGAGGGAAGCAATTC
AATTTGAAGTCCCTGTGAATGGGCTTTCAGAAGGCAATTAAAGAAATCCACTCAGAGAGGAC
TTGGGGTGAAACTTGGGTCCTGTGGTTTTCTGATTGTAAGTGGAAGCAGGTCTTGCACACGC
TGTTGGCAAATGTCAGGACCAGGTTAAGTGACTGGCAGAAAAACTTCCAGGTGGAACAAGCA
ACCCATGTTCTGCTGCAAGCTTGAAGGAGCCTGGAGCGGGAGAAAGCTAACTTGAACATGAC
CTGTTGCATTTGGCAAGTTCTAGCAACATGCTCCTAAGGAAGCGATACAGGCACAGACCATG
CAGACTCCAGTTCCTCCTGCTGCTCCTGATGCTGGGATGCGTCCTGATGATGGTGGCGATGT
TGCACCCTCCCCACCACACCCTGCACCAGACTGTCACAGCCCAAGCCAGCAAGCACAGCCCT
GAAGCCAGGTACCGCCTGGACTTTGGGGAATCCCAGGATTGGGTACTGGAAGCTGAGGATGA
GGGTGAAGAGTACAGCCCTCTGGAGGGCCTGCCACCCTTTATCTCACTGCGGGAGGATCAGC
TGCTGGTGGCCGTGGCCTTACCCCAGGCCAGAAGGAACCAGAGCCAGGGCAGGAGAGGTGGG
AGCTACCGCCTCATCAAGCAGCCAAGGAGGCAGGATAAGGAAGCCCCAAAGAGGGACTGGGG
GGCTGATGAGGACGGGGAGGTGTCTGAAGAAGAGGAGTTGACCCCGTTCAGCCTGGACCCAC
GTGGCCTCCAGGAGGCACTCAGTGCCCGCATCCCCTCCAGAGGGCTCTGCCCGAGGTGCGG
CACCCACTGTGTCTGCAGCAGCACCCTCAGGACAGCCTGCCCACAGCCAGCGTCATCCTCTG
TTTCCATGATGAGGCCTGGTCCACTCTCCTGCGGACTGTACACAGCATCCTCGACACAGTGC
CCAGGGCCTTCCTGAAGGAGATCATCCTCGTGGACGACCTCAGCCAGCAAGGACAACTCAAG
TCTGCTCTCAGCGAATATGTGGCCAGGCTGGAGGGGGTGAAGTTACTCAGGAGCAACAAGAG
GCTGGGTGCCATCAGGGCCCGGATGCTGGGGGCCACCAGAGCCACCGGGGATGTGCTCGTCT
TCATGGATGCCCACTGCGAGTGCCACCCAGGCTGGCTGGAGCCCCTCCTCAGCAGAATAGCT
GGTGACAGGAGCCGAGTGGTATCTCCGGTGATAGATGTGATTGACTGGAAGACTTTCCAGTA
TTACCCCTCAAAGGACCTGCAGCGTGGGGTGTTGGACTGGAAGCTGGATTTCCACTGGGAAC
CTTTGCCAGAGCATGTGAGGAAGGCCCTCCAGTCCCCCATAAGCCCCATCAGGAGCCCTGTG
GTGCCCGGAGAGGTGGTGGCCATGGACAGACATTACTTCCAAAACACTGGAGCGTATGACTC
TCTTATGTCGCTGCGAGGTGGTGAAAACCTCGAACTGTCTTTCAAGGCCTGGCTCTGTGGTG
GCTCTGTTGAAATCCTTCCCTGCTCTCGGGTAGGACACATCTACCAAAATCAGGATTCCCAT
TCCCCCCTCGACCAGGAGGCCACCCTGAGGAACAGGGTTCGCATTGCTGAGACCTGGCTGGG
GTCATTCAAAGAAACCTTCTACAAGCATAGCCCAGAGGCCTTCTCCTTGAGCAAGGCTGAGA
AGCCAGACTGCATGGAACGCTTGCAGCTGCAAAGGAGACTGGGTTGTCGGACATTCCACTGG
TTTCTGGCTAATGTCTACCCTGAGCTGTACCCATCTGAACCCAGGCCCAGTTTCTCTGGAAA
GCTCCACAACACTGGACTTGGGCTCTGTGCAGACTGCCAGGCAGAAGGGGACATCCTGGGCT
GTCCCATGGTGTTGGCTCCTTGCAGTGACAGCCGGCAGCAACAGTACCTGCAGCACACCAGC
AGGAAGGAGATTCACTTTGGCAGCCCACAGCACCTGTGCTTTGCTGTCAGGCAGGAGCAGGT
GATTCTTCAGAACTGCACGGAGGAAGGCCTGGCCATCCACCAGCAGCACTGGGACTTCCAGG
AGAATGGGATGATTGTCCACATTCTTTCTGGGAAATGCATGGAAGCTGTGGTGCAAGAAAAC
AATAAAGATTTGTACCTGCGTCCGTGTGATGGAAAAGCCCGCCAGCAGTGGCGATTTGACCA
GATAAATGCTGTGGATGAACGATGAATGTCAATGTCAGAAGGAAAGAGAATTTTGGCCATC
AAAATCCAGCTCCAAGTGAACGTAAAGAGCTTATATATTTCATGAAGCTGATCCTTTTGTGT
GTGTGCTCCTTGTGTTAGGAGAGAAAAAAGCTCTATGAAAGAATATAGGAAGTTTCTCCTTT
TCACACCTTATTTCATTGACTGCTGGCTGCTTA
```

FIGURE 202

></usr/seqdb2/sst/DNA/Dnaseqs.min/ss.DNA73760
><subunit 1 of 1, 639 aa, 1 stop
><MW: 73063, pI: 6.84, NX(S/T): 2
MLLRKRYRHRPCRLQFLLLLLMLGCVLMMVAMLHPPHHTLHQTVTAQASKHSPEARYRLDFG
ESQDWVLEAEDEGEEYSPLEGLPPFISLREDQLLVAVALPQARRNQSQGRRGGSYRLIKQPR
RQDKEAPKRDWGADEDGEVSEEEELTPFSLDPRGLQEALSARIPLQRALPEVRHPLCLQQHP
QDSLPTASVILCFHDEAWSTLLRTVHSILDTVPRAFLKEIILVDDLSQQGQLKSALSEYVAR
LEGVKLLRSNKRLGAIRARMLGATRATGDVLVFMDAHCECHPGWLEPLLSRIAGDRSRVVSP
VIDVIDWKTFQYYPSKDLQRGVLDWKLDFHWEPLPEHVRKALQSPISPIRSPVVPGEVVAMD
RHYFQNTGAYDSLMSLRGGENLELSFKAWLCGGSVEILPCSRVGHIYQNQDSHSPLDQEATL
RNRVRIAETWLGSFKETFYKHSPEAFSLSKAEKPDCMERLQLQRRLGCRTFHWFLANVYPEL
YPSEPRPSFSGKLHNTGLGLCADCQAEGDILGCPMVLAPCSDSRQQQYLQHTSRKEIHFGSP
QHLCFAVRQEQVILQNCTEEGLAIHQQHWDFQENGMIVHILSGKCMEAVVQENNKDLYLRPC
DGKARQQWRFDQINAVDER

Signal peptide:
amino acids 1-28

FIGURE 203

CGCCAAGCATGCAGTAAAGGCTGAAAATCTGGGTCACAGCTGAGGAAGACCTCAGACATGGA
GTCCAGGATGTGGCCTGCGCTGCTGCTGTCCCACCTCCTCCCTCTCTGGCCACTGCTGTTGC
TGCCCCTCCCACCGCCTGCTCAGGGCTCTTCATCCTCCCCTCGAACCCCACCAGCCCCAGCC
CGCCCCCGTGTGCCAGGGGAGGCCCCTCGGCCCCACGTCATGTGTGCGTGTGGGAGCGAGC
ACCTCCACCAAGCCGATCTCCTCGGGTCCAAGATCACGTCGGCAAGTCCTGCCTGGCACTG
CACCCCCAGCCACCCCATCAGGCTTTGAGGAGGGGCCGCCCTCATCCCAATACCCCTGGGCT
ATCGTGTGGGGTCCCACCGTGTCTCGAGAGGATGGAGGGGACCCCAACTCTGCCAATCCCGG
ATTTCTGGACTATGGTTTTGCAGCCCCTCATGGGCTCGCAACCCCACACCCCAACTCAGACT
CCATGCGAGGTGATGGAGATGGGCTTATCCTTGGAGAGGCACCTGCCACCCTGCGGCCATTC
CTGTTCGGGGGCCGTGGGGAAGGTGTGGACCCCCAGCTCTATGTCACAATTACCATCTCCAT
CATCATTGTTCTCGTGGCCACTGGCATCATCTTCAAGTTCTGCTGGGACCGCAGCCAGAAGC
GACGCAGACCCTCAGGGCAGCAAGGTGCCCTGAGGCAGGAGGAGAGCCAGCAGCCACTGACA
GACCTGTCCCCGGCTGGAGTCACTGTGCTGGGGCCTTCGGGGACTCACCTACCCCCACCCC
TGACCATGAGGAGCCCCGAGGGGGACCCCGGCCTGGGATGCCCCACCCCAAGGGGGCTCCAG
CCTTCCAGTTGAACCGGTGAGGGCAGGGCAATGGGATGGGAGGGCAAAGAGGGAAGGCAAC
TTAGGTCTTCAGAGCTGGGGTGGGGGTGCCCTCTGGATGGGTAGTGAGGAGGCAGGCGTGGC
CTCCCACAGCCCCTGGCCCTCCCAAGGGGGCTGGACCAGCTCCTCTCTGGGAGGCACCCTTC
CTTCTCCCAGTCTCTCAGGATCTGTGTCCTATTCTCTGCTGCCCATAACTCCAACTCTGCCC
TCTTTGGTTTTTTCTCATGCCACCTTGTCTAAGACAACTCTGCCCTCTTAACCTTGATTCCC
CCTCTTTGTCTTGAACTTCCCCTTCTATTCTGGCCTACCCCTTGGTTCCTGACTGTGCCCTT
TCCCTCTTCCTCTCAGGATTCCCCTGGTGAATCTGTGATGCCCCAATGTTGGGGTGCAGCC
AAGCAGGAGGCCAAGGGGCCGGCACAGCCCCATCCCACTGAGGGTGGGGCAGCTGTGGGGA
GCTGGGGCCACAGGGGCTCCTGGCTCCTGCCCCTTGCACACCACCGGAACACTCCCCAGCC
CCACGGGCAATCCTATCTGCTCGCCCTCCTGCAGGTGGGGGCCTCACATATCTGTGACTTCG
GGTCCCTGTCCCCACCCTTGTGCACTCACATGAAAGCCTTGCACACTCACCTCCACCTTCAC
AGGCCATTTGCACACGCTCCTGCACCCTCTCCCCGTCCATACCGCTCCGCTCAGCTGACTCT
CATGTTCTCTCGTCTCACATTTGCACTCTCTCCTTCCCACATTCTGTGCTCAGCTCACTCAG
TGGTCAGCGTTTCCTGCACACTTTACCTCTCATGTGCGTTTCCCGGCCTGATGTTGTGGTGG
TGTGCGGCGTGCTCACTCTCTCCCTCATGAACACCCACCCACCTCGTTTCCGCAGCCCTGC
GTGCTGCTCCAGAGGTGGGTGGGAGGTGAGCTGGGGGCTCCTTGGGCCCTCATCGGTCATGG
TCTCGTCCCATTCCACACCATTTGTTTCTCTGTCTCCCCATCCTACTCCAAGGATGCCGGCA
TCACCCTGAGGGCTCCCCCTTGGGAATGGGGTAGTGAGGCCCCAGACTTCACCCCCAGCCCA
CTGCTAAAATCTGTTTTCTGACAGATGGGTTTTGGGGAGTCGCCTGCTGCACTACATGAGAA
AGGGACTCCCATTTGCCCTTCCCTTTCTCCTACAGTCCCTTTTGTCTTGTCTGTCCTGGCTG
TCTGTGTGTGTGCCATTCTCTGGACTTCAGAGCCCCCTGAGCCAGTCCTCCCTTCCCAGCCT
CCCTTTGGGCCTCCCTAACTCCACCTAGGCTGCCAGGGACCGGAGTCAGCTGGTTCAAGGCC
ATCGGGAGCTCTGCCTCCAAGTCTACCCTTCCCTTCCGGACTCCCTCCTGTCCCCTCCTTT
CCTCCCTCCTTCCTTCCACTCTCCTTCCTTTTGCTTCCCTGCCCTTTCCCCCTCCTCAGGTT
CTTCCCTCCTTCTCACTGGTTTTTCCACCTTCCTCCTTCCCTTCTTCCCTGGCTCCTAGGCT
GTGATATATATTTTTGTATTATCTCTTTCTTCTTCTTGTGGTGATCATCTTGAATTACTGTG
GGATGTAAGTTTCAAAATTTTCAAATAAAGCCTTTGCAAGATAA

FIGURE 204

></usr/seqdb2/sst/DNA/Dnaseqs.min/ss.DNA76393
><subunit 1 of 1, 243 aa, 1 stop
><MW: 26266, pI: 8.43, NX(S/T): 1
MRPQGPAASPQRLRGLLLLLLLQLPAPSSASEIPKGKQKAQLRQREVVDLYNGMCLQGPAGV
PGRDGSPGANVIPGTPGIPGRDGFKGEKGECLRESFEESWTPNYKQCSWSSLNYGIDLGKIA
ECTFTKMRSNSALRVLFSGSLRLKCRNACCQRWYFTFNGAECSGPLPIEAIIYLDQGSPEMN
STINIHRTSSVEGLCEGIGAGLVDVAIWVGTCSDYPKGDASTGWNSVSRIIIEELPK

Signal peptide:

amino acids 1-30

Transmembrane domain:

amino acids 195-217

FIGURE 205

GTTAACCAGCGCAGTCCTCCGTGCGTCCCGCCCGCCGCTGCCCTCACTCCCGGCCAGGATGG
CATCCTGTCTGGCCCTGCGCATGGCGCTGCTGCTGGTCTCCGGGGTTCTGGCCCTGCGGTG
CTCACAGACGATGTTCCACAGGAGCCCGTGCCCACGCTGTGGAACGAGCCGGCCGAGCTGCC
GTCGGGAGAAGGCCCCGTGGAGAGCACCAGCCCCGGCCGGGAGCCCGTGGACACCGGTCCCC
CAGCCCCCACCGTCGCGCCAGGACCCGAGGACAGCACCGCGCAGGAGCGGCTGGACCAGGGC
GGCGGGTCGCTGGGGCCCGGCGCTATCGCGGCCATCGTGATCGCCGCCCTGCTGGCCACCTG
CGTGGTGCTGGCGCTCGTGGTCGTCGCGCTGAGAAAGTTTTCTGCCTCCTGAAGCGAATAAA
GGGGCCGCGCCCGGCCGCGGCGCGACTCGGCAAAAAAAAAAAAAAA

FIGURE 206

></usr/seqdb2/sst/DNA/Dnaseqs.min/ss.DNA76398
><subunit 1 of 1, 121 aa, 1 stop
><MW: 12073, pI: 4.11, NX(S/T): 0
MASCLALRMALLLVSGVLAPAVLTDDVPQEPVPTLWNEPAELPSGEGPVESTSPGREPVDTG
PPAPTVAPGPEDSTAQERLDQGGGSLGPGAIAAIVIAALLATCVVLALVVVALRKFSAS Important features of the protein:
Signal peptide:
amino acids 1-19

Transmembrane domain:
amino acids 91-110

Glycosaminoglycan attachment site.
amino acids 44-47 cAMP- and cGMP-dependent protein kinase phosphorylation site.
amino acids 116-119

N-myristoylation site.
amino acids 91-96

FIGURE 207

GGCCGTTGGTTGGTGCGCGGCTGAAGGGTGTGGCGCGAGCAGCGTCGTTGGTTGGCCGGCGG
CGGGCCGGGACGGGATGGCCCTGCTGCTGTGCCTGGTGTGCCTGACGGCGGCGCTGGCCCA
CGGCTGTCTGCACTGCCACAGCAACTTCTCCAAGAAGTTCTCCTTCTACCGCCACCATGTGA
ACTTCAAGTCCTGGTGGGTGGGCGACATCCCCGTGTCAGGGGCGCTGCTCACCGACTGGAGC
GACGACACGATGAAGGAGCTGCACCTGGCCATCCCCGCCAAGATCACCCGGGAGAAGCTGGA
CCAAGTGGCGACAGCAGTGTACCAGATGATGGATCAGCTGTACCAGGGGAAGATGTACTTCC
CCGGGTATTTCCCCAACGAGCTGCGAAACATCTTCCGGGAGCAGGTGCACCTCATCCAGAAC
GCCATCATCGAAAGGCACCTGGCACCAGGCAGCTGGGGAGGAGGGCAGCTCTCCAGGGAGGG
ACCCAGCCTAGCACCTGAAGGATCAATGCCATCACCCCGCGGGGACCTCCCCTAAGTAGCCC
CCAGAGGCGCTGGGAGTGTTGCCACCGCCCTCCCCTGAAGTTTGCTCCATCTCACGCTGGGG
GTCAACCTGGGGACCCCTTCCCTCCGGGCCATGGACACACATACATGAAAACCAGGCCGCAT
CGACTGTCAGCACCGCTGTGGCATCTTCCAGTACGAGACCATCTCCTGCAACAACTGCACAG
ACTCGCACGTCGCCTGCTTTGGCTATAACTGCGAGTAGGGCTCAGGCATCACACCCACCCGT
GCCAGGGCCCTACTGTCCCTGGGGTCCCAGGCTCTCCTTGGAGGGGGCTCCCCGCCTTCCAC
CTGGCTGTCATCGGGTAGGGCGGGGCCGTGGGTTCAGGGGCGCACCACTTCCAAGCCTGTGT
CCCACAGGTCCTCGGCGCAGTGGAAGTCAGCTGTCCAGGGCCTCCTGAACTACATAAATAAC
TGGCACAAGTAAGTCCCCTCCTCAAACCAACACAGGCAGTGTGTGTATGTGAGCACCTCGTG
GGTGAGTATGTGTGGGGCACAGGCTGGCTCCCTCAGCTCCCACGTCCTAGAGGGGCTCCCGA
GGAGGTGGAACCTCAACCCAGCTCTGCGCAGGAGGCGGCTGCAGTCCTTTTCTCCCTCAAAG
GTCTCCGACCCTCAGCTGGAGGCGGGCATCTTTCCTAAAGGGTCCCCATAGGGTCTGGTTCC
ACCCCATCCCAGGTCTGTGGTCAGAGCCTGGGAGGGTTCCCTACGATGGTTAGGGGTGCCCC
ATGGAGGGGCTGACTGCCCCACATTGCCTTTCAGACAGGACACGAGCATGAGGTAAGGCCGC
CCTGACCTGGACTTCAGGGGGAGGGGGTAAAGGGAGAGAGGAGGGGGGCTAGGGGGTCCTCT
AGATCAGTGGGGGCACTGCAGGTGGGGCTCTCCCTATACCTGGGACACCTGCTGGATGTCAC
CTCTGCAACCACACCCATGTGGTGGTTTCATGAACAGACCACGCTCCTCTGCCTTCTCCTGG
CCTGGGACACACAGAGCCACCCCGGCCTTGTGAGTGACCCAGAGAAGGGAGGCCTCGGGAGA
AGGGGTGCTCGTAAGCCAACACCAGCGTGCCGCGGCCTGCACACCCTTCGGACATCCCAGGC
ACGAGGGTGTCGTGGATGTGGCCACACATAGGACCACACGTCCCAGCTGGGAGGAGAGGCCT
GGGGCCCCAGGGAGGGAGGCAGGGGTGGGGACATGGAGAGCTGAGGCAGCCTCGTCTCC
CCGCAGCCTGGTATCGCCAGCCTTAAGGTGTCTGGAGCCCCACACTTGGCCAACCTGACCT
TGGAAGATGCTGCTGAGTGTCTCAAGCAGCACTGACAGCAGCTGGGCCTGCCCCAGGGCAAC
GTGGGGCGGAGACTCAGCTGGACAGCCCTGCCTGTCACTCTGGAGCTGGGCTGCTGCTGC
CTCAGGACCCCCTCTCCGACCCCGGACAGAGCTGAGCTGGCCAGGGCCAGGAGGGCGGGAGG
GAGGGAATGGGGGTGGGCTGTGCGCAGCATCAGCGCCTGGGCAGGTCCGCAGAGCTGCGGGA
TGTGATTAAAGTCCCTGATGTTTCTC

FIGURE 208

></usr/seqdb2/sst/DNA/Dnaseqs.min/ss.DNA76399
><subunit 1 of 1, 157 aa, 1 stop
><MW: 17681, pI: 7.65, NX(S/T): 1
MALLLCLVCLTAALAHGCLHCHSNFSKKFSFYRHHVNFKSWWVGDIPVSGALLTDWSDDTMK
ELHLAIPAKITREKLDQVATAVYQMMDQLYQGKMYFPGYFPNELRNIFREQVHLIQNAIIER
HLAPGSWGGGQLSREGPSLAPEGSMPSPRGDLP

Signal peptide:
amino acids 1-15

FIGURE 209

AGCAGGAGCAGGAGAGGGACAATGGAAGCTGCCCCGTCCAGGTTCATGTTCCTCTTATTTCT
CCTCACGTGTGAGCTGGCTGCAGAAGTTGCTGCAGAAGTTGAGAAATCCTCAGATGGTCCTG
GTGCTGCCCAGGAACCCACGTGGCTCACAGATGTCCCAGCTGCCATGGAATTCATTGCTGCC
ACTGAGGTGGCTGTCATAGGCTTCTTCCAGGATTTAGAAATACCAGCAGTGCCCATACTCCA
TAGCATGGTGCAAAAATTCCCAGGCGTGTCATTTGGGATCAGCACTGATTCTGAGGTTCTGA
CACACTACAACATCACTGGGAACACCATCTGCCTCTTTCGCCTGGTAGACAATGAACAACTG
AATTTAGAGGACGAAGACATTGAAAGCATTGATGCCACCAAATTGAGCCGTTTCATTGAGAT
CAACAGCCTCCACATGGTGACAGAGTACAACCCTGTGACTGTGATTGGGTTATTCAACAGCG
TAATTCAGATTCATCTCCTCCTGATAATGAACAAGGCCTCCCCAGAGTATGAAGAGAACATG
CACAGATACCAGAAGGCAGCCAAGCTCTTCCAGGGGAAGATTCTCTTTATTCTGGTGGACAG
TGGTATGAAGAAAATGGGAAGGTGATATCATTTTTCAAACTAAAGGAGTCTCAACTGCCAG
CTTTGGCAATTTACCAGACTCTAGATGACGAGTGGGATACACTGCCCACAGCAGAAGTTTCC
GTAGAGCATGTGCAAAACTTTTGTGATGGATTCCTAAGTGGAAAATTGTTGAAAGAAAATCG
TGAATCAGAAGGAAAGACTCCAAAGGTGGAACTCTGACTTCTCCTTGGAACTACATATGGCC
AAGTATCTACTTTATGCAAAGTAAAAAGGCACAACTCAAATCTCAGAGACACTAAACAACAG
GATCACTAGGCCTGCCAACCACACACACACGCACGTGCACACACGCACGCACGCGTGCACAC
ACACACGCGCACACACACACACACAGAGCTTCATTTCCTGTCTTAAAATCTCGTTTTCTC
TTCTTCCTTCTTTTAAATTTCATATCCTCACTCCCTATCCAATTTCCTTCTTATCGTGCATT
CATACTCTGTAAGCCCATCTGTAACACACCTAGATCAAGGCTTTAAGAGACTCACTGTGATG
CCTCTATGAAAGAGAGGCATTCCTAGAGAAAGATTGTTCCAATTTGTCATTTAATATCAAGT
TTGTATACTGCACATGACTTACACACAACATAGTTCCTGCTCTTTTAAGGTTACCTAAGGGT
TGAAACTCTACCTTCTTTCATAAGCACATGTCCGTCTCTGACTCAGGATCAAAAACCAAGG
ATGGTTTTAAACACCTTTGTGAAATTGTCTTTTTGCCAGAAGTTAAAGGCTGTCTCCAAGTC
CCTGAACTCAGCAGAAATAGACCATGTGAAAACTCCATGCTTGGTTAGCATCTCCAACTCCC
TATGTAAATCAACAACCTGCATAATAAATAAAAGGCAATCATGTTATA

FIGURE 210

></usr/seqdb2/sst/DNA/Dnaseqs.min/ss.DNA76401
><subunit 1 of 1, 273 aa, 1 stop
><MW: 30480, pI: 4.60, NX(S/T): 1
MEAAPSRFMFLLFLLTCELAAEVAAEVEKSSDGPGAAQEPTWLTDVPAAMEFIAATEVAVIG
FFQDLEIPAVPILHSMVQKFPGVSFGISTDSEVLTHYNITGNTICLFRLVDNEQLNLEDEDI
ESIDATKLSRFIEINSLHMVTEYNPVTVIGLFNSVIQIHLLLIMNKASPEYEENMHRYQKAA
KLFQGKILFILVDSGMKENGKVISFFKLKESQLPALAIYQTLDDEWDTLPTAEVSVEHVQNF
CDGFLSGKLLKENRESEGKTPKVEL

Signal peptide:

amino acids 1-20

Transmembrane domain:

amino acids 143-162

FIGURE 211

GGAGAGCCGCGGCTGGGACCGGAGTGGGGAGCGCGGCGTGGAGGTGCCACCCGGCGCGGGTG
GCGGAGAGATCAGAAGCCTCTTCCCCAAGCCGAGCCAACCTCAGCGGGGACCCGGGCTCAGG
GACGCGGCGGCGGCGGCGACTGCAGTGGCTGGACATGGCAGCGTCCGCCGGAGCCGGG
GCGGTGATTGCAGCCCCAGACAGCCGGCGCTGGCTGTGGTCGGTGCTGGCGGCGGCGCTTGG
GCTCTTGACAGCTGGAGTATCAGCCTTGGAAGTATATACGCCAAAAGAAATCTTCGTGGCAA
ATGGTACACAAGGGAAGCTGACCTGCAAGTTCAAGTCTACTAGTACGACTGGCGGGTTGACC
TCAGTCTCCTGGAGCTTCCAGCCAGAGGGGCCGACACTACTGTGTCGTTTTTCCACTACTC
CCAAGGGCAAGTGTACCTTGGGAATTATCCACCATTTAAAGACAGAATCAGCTGGGCTGGAG
ACCTTGACAAGAAAGATGCATCAATCAACATAGAAAATATGCAGTTTATACACAATGGCACC
TATATCTGTGATGTCAAAAACCCTCCTGACATCGTTGTCCAGCCTGGACACATTAGGCTCTA
TGTCGTAGAAAAAGAGAATTTGCCTGTGTTTCCAGTTTGGGTAGTGGTGGGCATAGTTACTG
CTGTGGTCCTAGGTCTCACTCTGCTCATCAGCATGATTCTGGCTGTCCTCTATAGAAGGAAA
AACTCTAAACGGGATTACACTGGCTGCAGTACATCAGAGAGTTTGTCACCAGTTAAGCAGGC
TCCTCGGAAGTCCCCCTCCGACACTGAGGGTCTTGTAAAGAGTCTGCCTTCTGGATCTCACC
AGGGCCCAGTCATATATGCACAGTTAGACCACTCCGGCGGACATCACAGTGACAAGATTAAC
AAGTCAGAGTCTGTGGTGTATGCGGATATCCGAAAGAATTAAGAGAATACCTAGAACATATC
CTCAGCAAGAAACAAAACCAAACTGGACTCTCGTGCAGAAAATGTAGCCCATTACCACATGT
AGCCTTGGAGACCCAGGCAAGGACAAGTACACGTGTACTCACAGAGGGAGAGAAAGATGTGT
ACAAAGGATATGTATAAATATTCTATTTAGTCATCCTGATATGAGGAGCCAGTGTTGCATGA
TGAAAAGATGGTATGATTCTACATATGTACCCATTGTCTTGCTGTTTTGTACTTTCTTTTC
AGGTCATTTACAATTGGGAGATTTCAGAAACATTCCTTTCACCATCATTTAGAAATGGTTTG
CCTTAATGGAGACAATAGCAGATCCTGTAGTATTTCCAGTAGACATGGCCTTTTAATCTAAG
GGCTTAAGACTGATTAGTCTTAGCATTTACTGTAGTTGGAGGATGGAGATGCTATGATGGAA
GCATACCCAGGGTGGCCTTTAGCACAGTATCAGTACCATTTATTTGTCTGCCGCTTTTAAAA
AATACCCATTGGCTATGCCACTTGAAAACAATTTGAGAAGTTTTTTTGAAGTTTTTCTCACT
AAAATATGGGGCAATTGTTAGCCTTACATGTTGTGTAGACTTACTTTAAGTTTGCACCCTTG
AAATGTGTCATATCAATTTCTGGATTCATAATAGCAAGATTAGCAAAGGATAAATGCCGAAG
GTCACTTCATTCTGGACACAGTTGGATCAATACTGATTAAGTAGAAAATCCAAGCTTTGCTT
GAGAACTTTTGTAACGTGGAGAGTAAAAAGTATCGGTTTTA

FIGURE 212

></usr/seqdb2/sst/DNA/Dnaseqs.min/ss.DNA76510
><subunit 1 of 1, 269 aa, 1 stop
><MW: 29082, pI: 9.02, NX(S/T): 3
MAASAGAGAVIAAPDSRRWLWSVLAAALGLLTAGVSALEVYTPKEIFVANGTQGKLTCKFKS
TSTTGGLTSVSWSFQPEGADTTVSFFHYSQGQVYLGNYPPFKDRISWAGDLDKKDASINIEN
MQFIHNGTYICDVKNPPDIVVQPGHIRLYVVEKENLPVFPVWVVVGIVTAVVLGLTLLISMI
LAVLYRRKNSKRDYTGCSTSESLSPVKQAPRKSPSDTEGLVKSLPSGSHQGPVIYAQLDHSG
GHHSDKINKSESVVYADIRKN

Signal peptide:

amino acids 1-37

Transmembrane domain:

amino acids 161-183

FIGURE 213

GCCGGCTGTGCAGAGACGCCATGTACCGGCTCCTGTCAGCAGTGACTGCCCGGGCTGCCGCC
CCCGGGGGCTTGGCCTCAAGCTGCGGACGACGCGGGGTCCATCAGCGCGCCGGGCTGCCGCC
TCTCGGCCACGGCTGGGTCGGGGGCCTCGGGCTGGGGCTGGGGCTGGCGCTCGGGGTGAAGC
TGGCAGGTGGGCTGAGGGGCGCGGCCCCGGCGCAGTCCCCGCGGCCCCCGACCCTGAGGCG
TCGCCTCTGGCCGAGCCGCCACAGGAGCAGTCCCTCGCCCCGTGGTCTCCGCAGACCCCGGC
GCCGCCCTGCTCCAGGTGCTTCGCCAGAGCCATCGAGAGCAGCCGCGACCTGCTGCACAGGA
TCAAGGATGAGGTGGGCGCACCGGGCATAGTGGTTGGAGTTTCTGTAGATGGAAAAGAAGTC
TGGTCAGAAGGTTTAGGTTATGCTGATGTTGAGAACCGTGTACCATGTAAACCAGAGACAGT
TATGCGAATTGCTAGCATCAGCAAAAGTCTCACCATGGTTGCTCTTGCCAAATTGTGGGAAG
CAGGGAAACTGGATCTTGATATTCCAGTACAACATTATGTTCCCGAATTCCCAGAAAAAGAA
TATGAAGGTGAAAAGGTTTCTGTCACAACAAGATTACTGATTTCCCATTTAAGTGGAATTCG
TCATTATGAAAAGGACATAAAAAAGGTGAAAGAAGAGAAAGCTTATAAAGCCTTGAAGATGA
TGAAAGAGAATGTTGCATTTGAGCAAGAAAAGAAGGCAAAAGTAATGAAAAGAATGATTTT
ACTAAATTTAAAACAGAGCAGGAGAATGAAGCCAAATGCCGGAATTCAAAACCTGGCAAGAA
AAAGAATGATTTTGAACAAGGCGAATTATATTTGAGAGAAAGTTTGAAAATTCAATTGAAT
CCCTAAGATTATTTAAAAATGATCCTTTGTTCTTCAAACCTGGTAGTCAGTTTTTGTATTCA
ACTTTTGGCTATACCCTACTGGCAGCCATAGTAGAGAGCTTCAGGATGTAAATATTTGGA
CTATATGCAGAAAATATTCCATGACTTGGATATGCTGACGACTGTGCAGGAAGAAAACGAGC
CAGTGATTTACAATAGAGCAAGGTAAATGAATACCTTCTGCTGTGTCTAGCTATATCGCATC
TTAACACTATTTTATTAATTAAAAGTCAAATTTTCTTTGTTTCCATTCCAAAATCAACCTGC
CACATTTTGGGAGCTTTTCTACATGTCTGTTTTCTCATCTGTAAAGTGAAGGAAGTAAAACA
TGTTTATAAAGTAAAAAAA

FIGURE 214

></usr/seqdb2/sst/DNA/Dnaseqs.min/ss.DNA76522
><subunit 1 of 1, 373 aa, 1 stop
><MW: 41221, pI: 8.54, NX(S/T): 0
MYRLLSAVTARAAAPGGLASSCGRRGVHQRAGLPPLGHGWVGGLGLGLGLALGVKLAGGLRG
AAPAQSPAAPDPEASPLAEPPQEQSLAPWSPQTPAPPCSRCFARAIESSRDLLHRIKDEVGA
PGIVVGVSVDGKEVWSEGLGYADVENRVPCKPETVMRIASISKSLTMVALAKLWEAGKLDLD
IPVQHYVPEFPEKEYEGEKVSVTTRLLISHLSGIRHYEKDIKKVKEEKAYKALKMMKENVAF
EQEKEGKSNEKNDFTKFKTEQENEAKCRNSKPGKKKNDFEQGELYLREKFENSIESLRLFKN
DPLFFKPGSQFLYSTFGYTLLAAIVERASGCKYLDYMQKIFHDLDMLTTVQEENEPVIYNRAR

Signal peptide:

amino acids 1-19

Transmembrane domain:

amino acids 39-60

FIGURE 215

GTGACACTATAGAAGAGCTATGACGTCGCATGCACGCGTACGTAAGCTCGGAATTCGGCTCG
AGGCTGGTGGGAAGAAGCCGAGATGGCGGCAGCCAGCGCTGGGGCAACCCGGCTGCTCCTGC
TCTTGCTGATGGCGGTAGCAGCGCCCAGTCGAGCCCGGGGCAGCGGCTGCCGGGCCGGGACT
GGTGCGCGAGGGGCTGGGGCGGAAGGTCGAGAGGGCGAGGCCTGTGGCACGGTGGGCTGCT
GCTGGAGCACTCATTTGAGATCGATGACAGTGCCAACTTCCGGAAGCGGGGCTCACTGCTCT
GGAACCAGCAGGATGGTACCTTGTCCCTGTCACAGCGGCAGCTCAGCGAGGAGGAGCGGGGC
CGACTCCGGGATGTGGCAGCCCTGAATGGCCTGTACCGGGTCCGGATCCCAAGGCGACCCGG
GGCCCTGGATGGCCTGGAAGCTGGTGGCTATGTCTCCTCCTTTGTCCCTGCGTGCTCCCTGG
TGGAGTCGCACCTGTCGGACCAGCTGACCCTGCACGTGGATGTGGCCGGCAACGTGGTGGGC
GTGTCGGTGGTGACGCACCCCGGGGGCTGCCGGGGCCATGAGGTGGAGGACGTGGACCTGGA
GCTGTTCAACACCTCGGTGCAGCTGCAGCCGCCCACCACAGCCCCAGGCCCTGAGACGGCGG
CCTTCATTGAGCGCCTGGAGATGGAACAGGCCCAGAAGGCCAAGAACCCCCAGGAGCAGAAG
TCCTTCTTCGCCAAATACTGGATGTACATCATTCCCGTCGTCCTGTTCCTCATGATGTCAGG
AGCGCCAGACACCGGGGGCCAGGGTGGGGGTGGGGGTGGTGGTGGGGGTAGTGGCC
TTTGCTGTGTGCCACCCTCCCTGTAAGTCTATTTAAAAACATCGACGATACATTGAAATGTG
TGAACGTTTTGAAAAGCTACAGCTTCCAGCAGCCAAAAGCAACTGTTGTTTTGGCAAGACGG
TCCTGATGTACAAGCTTGATTGAAATTCACTGCTCACTTGATACGTTATTCAGAAACCCAAG
GAATGGCTGTCCCCATCCTCATGTGGCTGTGTGGAGCTCAGCTGTGTTGTGTGGCAGTTTAT
TAAACTGTCCCCCAGATCGACACGCAAAAAAAAA

FIGURE 216

```
></usr/seqdb2/sst/DNA/Dnaseqs.min/ss.DNA76529
><subunit 1 of 1, 269 aa, 1 stop
><MW: 28004, pI: 5.80, NX(S/T): 1
MAAASAGATRLLLLLLMAVAAPSRARGSGCRAGTGARGAGAEGREGEACGTVGLLLEHSFEI
DDSANFRKRGSLLWNQQDGTLSLSQRQLSEEERGRLRDVAALNGLYRVRIPRRPGALDGLEA
GGYVSSFVPACSLVESHLSDQLTLHVDVAGNVVGVSVVTHPGGCRGHEVEDVDLELFNTSVQ
LQPPTTAPGPETAAFIERLEMEQAQKAKNPQEQKSFFAKYWMYIIPVVLFLMMSGAPDTGGQ
GGGGGGGGGGGSGLCCVPPSL
```

Signal peptide:

amino acids 1-24

Transmembrane domain:

amino acids 226-243

FIGURE 217

```
GGAGCGCTGCTGGAACCCGAGCCGGAGCCGGAGCCACAGCGGGGAGGGTGGCCTGGCGGCCT
GGAGCCGGACGTGTCCGGGGCGTCCCCGCAGACCGGGGCAGCAGGTCGTCCGGGGGCCCACC
ATGCTGGTGACTGCCTACCTTGCTTTTGTAGGCCTCCTGGCCTCCTGCCTGGGGCTGGAACT
GTCAAGATGCCGGGCTAAACCCCCTGGAAGGGCCTGCAGCAATCCCTCCTTCCTTCGGTTTC
AACTGGACTTCTATCAGGTCTACTTCCTGGCCCTGGCAGCTGATTGGCTTCAGGCCCCCTAC
CTCTATAAACTCTACCAGCATTACTACTTCCTGGAAGGTCAAATTGCCATCCTCTATGTCTG
TGGCCTTGCCTCTACAGTCCTCTTTGGCCTAGTGGCCTCCTCCCTTGTGGATTGGCTGGGTC
GCAAGAATTCTTGTGTCCTCTTCTCCCTGACTTACTCACTATGCTGCTTAACCAAACTCTCT
CAAGACTACTTTGTGCTGCTAGTGGGGCGAGCACTTGGTGGGCTGTCCACAGCCCTGCTCTT
CTCAGCCTTCGAGGCCTGGTATATCCATGAGCACGTGGAACGGCATGACTTCCCTGCTGAGT
GGATCCCAGCTACCTTTGCTCGAGCTGCCTTCTGGAACCATGTGCTGGCTGTAGTGGCAGGT
GTGGCAGCTGAGGCTGTAGCCAGCTGGATAGGGCTGGGGCCTGTAGCGCCCTTTGTGGCTGC
CATCCCTCTCCTGGCTCTGGCAGGGCCTTGGCCCTTCGAAACTGGGGGGAGAACTATGACC
GGCAGCGTGCCTTCTCAAGGACCTGTGCTGGAGGCCTGCGCTGCCTCCTGTCGGACCGCCGC
GTGCTGCTGCTGGGCACCATACAAGCTCTATTTGAGAGTGTCATCTTCATCTTTGTCTTCCT
CTGGACACCTGTGCTGGACCCACACGGGGCCCCTCTGGGCATTATCTTCTCCAGCTTCATGG
CAGCCAGCCTGCTTGGCTCTTCCCTGTACCGTATCGCCACCTCCAAGAGGTACCACCTTCAG
CCCATGCACCTGCTGTCCCTTGCTGTGCTCATCGTCGTCTTCTCTCTCTTCATGTTGACTTT
CTCTACCAGCCCAGGCCAGGAGAGTCCGGTGGAGTCCTTCATAGCCTTTCTACTTATTGAGT
TGGCTTGTGGATTATACTTTCCCAGCATGAGCTTCCTACGGAGAAAGGTGATCCCTGAGACA
GAGCAGGCTGGTGTACTCAACTGGTTCCGGGTACCTCTGCACTCACTGGCTTGCCTAGGGCT
CCTTGTCCTCCATGACAGTGATCGAAAAACAGGCACTCGGAATATGTTCAGCATTTGCTCTG
CTGTCATGGTGATGGCTCTGCTGGCAGTGGTGGGACTCTTCACCGTGGTAAGGCATGATGCT
GAGCTGCGGGTACCTTCACCTACTGAGGAGCCCTATGCCCCTGAGCTGTAACCCCACTCCAG
GACAAGATAGCTGGGACAGACTCTTGAATTCCAGCTATCCGGGATTGTACAGATCTCTCTGT
GACTGACTTTGTGACTGTCCTGTGGTTTCTCCTGCCATTGCTTTGTGTTTGGGAGGACATGA
TGGGGGTGATGGACTGGAAAGAAGGTGCCAAAAGTTCCCTCTGTGTTACTCCCATTTAGAAA
ATAAACACTTTTAAATGATCAAAAAAAAAAA
```

FIGURE 218

MLVTAYLAFVGLLASCLGLELSRCRAKPPGRACSNPSFLRFQLDFYQVYFLALAADWLQAPY
LYKLYQHYYFLEGQIAILYVCGLASTVLFGLVASSLVDWLGRKNSCVLFSLTYSLCCLTKLS
QDYFVLLVGRALGGLSTALLFSAFEAWYIHEHVERHDFPAEWIPATFARAAFWNHVLAVVAG
VAAEAVASWIGLGPVAPFVAAIPLLALAGALALRNWGENYDRQRAFSRTCAGGLRCLLSDRR
VLLLGTIQALFESVIFIFVFLWTPVLDPHGAPLGIIFSSFMAASLLGSSLYRIATSKRYHLQ
PMHLLSLAVLIVVFSLFMLTFSTSPGQESPVESFIAFLLIELACGLYFPSMSFLRRKVIPET
EQAGVLNWFRVPLHSLACLGLLVLHDSDRKTGTRNMFSICSAVMVMALLAVVGLFTVVRHDA
ELRVPSPTEEPYAPEL

Signal peptide:
amino acids 1-18

Transmembrane domain:
amino acids 41-55, 75-94, 127-143, 191-213, 249-270, 278-299,
314-330, 343-359, 379-394, 410-430

FIGURE 219

GCGACGCGCGGCGGGGCGGCGAGAGGAAACGCGGCGCCGGGCCGGGCCCGGCCCTGGAGATG
GTCCCCGGCGCCGCGGGCTGGTGTTGTCTCGTGCTCTGGCTCCCCGCGTGCGTCGCGGCCCA
CGGCTTCCGTATCCATGATTATTTGTACTTTCAAGTGCTGAGTCCTGGGGACATTCGATACA
TCTTCACAGCCACACCTGCCAAGGACTTTGGTGGTATCTTTCACACAAGGTATGAGCAGATT
CACCTTGTCCCCGCTGAACCTCCAGAGGCCTGCGGGAACTCAGCAACGGTTTCTTCATCCA
GGACCAGATTGCTCTGGTGGAGAGGGGGGCTGCTCCTTCCTCTCCAAGACTCGGGTGGTCC
AGGAGCACGGCGGGCGGCGGTGATCATCTCTGACAACGCAGTTGACAATGACAGCTTCTAC
GTGGAGATGATCCAGGACAGTACCCAGCGCACAGCTGACATCCCCGCCCTCTTCCTGCTCGG
CCGAGACGGCTACATGATCCGCCGCTCTCTGGAACAGCATGGGCTGCCATGGGCCATCATTT
CCATCCCAGTCAATGTCACCAGCATCCCCACCTTTGAGCTGCTGCAACCGCCCTGGACCTTC
TGGTAGAAGAGTTTGTCCCACATTCCAGCCATAAGTGACTCTGAGCTGGGAAGGGGAAACCC
AGGAATTTTGCTACTTGGAATTTGGAGATAGCATCTGGGGACAAGTGGAGCCAGGTAGAGGA
AAAGGGTTTGGGCGTTGCTAGGCTGAAAGGGAAGCCACACCACTGGCCTTCCCTTCCCCAGG
GCCCCCAAGGGTGTCTCATGCTACAAGAAGAGGCAAGAGACAGGCCCCAGGGCTTCTGGCTA
GAACCCGAAACAAAAGGAGCTGAAGGCAGGTGGCCTGAGAGCCATCTGTGACCTGTCACACT
CACCTGGCTCCAGCCTCCCCTACCCAGGGTCTCTGCACAGTGACCTTCACAGCAGTTGTTGG
AGTGGTTTAAAGAGCTGGTGTTTGGGGACTCAATAAACCCTCACTGACTTTTTAGCAATAAA
GCTTCTCATCAGGGTTGCAAAAAAAAAAAAAAAAAAAAAAAAAA

FIGURE 220

></usr/seqdb2/sst/DNA/Dnaseqs.min/ss.DNA76532
><subunit 1 of 1, 188 aa, 1 stop
><MW: 21042, pI: 5.36, NX(S/T): 2
MVPGAAGWCCLVLWLPACVAAHGFRIHDYLYFQVLSPGDIRYIFTATPAKDFGGIFHTRYEQ
IHLVPAEPPEACGELSNGFFIQDQIALVERGGCSFLSKTRVVQEHGGRAVIISDNAVDNDSF
YVEMIQDSTQRTADIPALFLLGRDGYMIRRSLEQHGLPWAIISIPVNVTSIPTFELLQPPWTFW

Signal peptide:
amino acids 1-20

FIGURE 221

TCTGCCTCCACTGCTCTGTGCTGGGATCATGGAACTTGCACTGCTGTGTGGGCTGGTGGTGA
TGGCTGGTGTGATTCCAATCCAGGGCGGGATCCTGAACCTGAACAAGATGGTCAAGCAAGTG
ACTGGGAAAATGCCCATCCTCTCCTACTGGCCCTACGGCTGTCACTGCGGACTAGGTGGCAG
AGGCCAACCCAAAGATGCCACGGACTGGTGCTGCCAGACCCATGACTGCTGCTATGACCACC
TGAAGACCCAGGGGTGCGGCATCTACAAGGACAACAACAAAAGCAGCATACATTGTATGGAT
TTATCTCAACGCTATTGTTTAATGGCTGTGTTTAATGTGATCTATCTGGAAAATGAGGACTC
CGAATAAAAAGCTATTACTAWTTNAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAA

FIGURE 222

></usr/seqdb2/sst/DNA/Dnaseqs.min/ss.DNA76538
><subunit 1 of 1, 116 aa, 1 stop
><MW: 12910, pI: 6.41, NX(S/T): 1
MELALLCGLVVMAGVIPIQGGILNLNKMVKQVTGKMPILSYWPYGCHCGLGGRGQPKDATDW
CCQTHDCCYDHLKTQGCGIYKDNNKSSIHCMDLSQRYCLMAVFNVIYLENEDSE

Important features of the protein:

Signal peptide:

amino acids 1-17

Transmembrane domain:

amino acids 1-24

N-glycosylation site.

amino acids 86-89

N-myristoylation sites.

amino acids 20-25, 45-50

Phospholipase A2 histidine active site.

amino acids 63-70

FIGURE 223

CTCGCTTCTTCCTTCTGGATGGGGGCCCAGGGGGCCCAGGAGAGTATAAAGGCGATGTGGAG
GGTGCCCGGCACAACCAGACGCCCAGTCACAGGCGAGAGCCCTGGGATGCACCGGCCAGAGG
CCATGCTGCTGCTGCTCACGCTTGCCCTCCTGGGGGGCCCCACCTGGGCAGGGAAGATGTAT
GGCCCTGGAGGAGGCAAGTATTTCAGCACCACTGAAGACTACGACCATGAAATCACAGGGCT
GCGGGTGTCTGTAGGTCTTCTCCTGGTGAAAAGTGTCCAGGTGAAACTTGGAGACTCCTGGG
ACGTGAAACTGGGAGCCTTAGGTGGGAATACCCAGGAAGTCACCCTGCAGCCAGGCGAATAC
ATCACAAAAGTCTTTGTCGCCTTCCAAGCTTTCCTCCGGGGTATGGTCATGTACACCAGCAA
GGACCGCTATTTCTATTTTGGGAAGCTTGATGGCCAGATCTCCTCTGCCTACCCCAGCCAAG
AGGGGCAGGTGCTGGTGGGCATCTATGGCCAGTATCAACTCCTTGGCATCAAGAGCATTGGC
TTTGAATGGAATTATCCACTAGAGGAGCCGACCACTGAGCCACCAGTTAATCTCACATACTC
AGCAAACTCACCCGTGGGTCGCTAGGGTGGGGTATGGGGCCATCCGAGCTGAGGCCATCTGT
GTGGTGGTGGCTGATGGTACTGGAGTAACTGAGTCGGGACGCTGAATCTGAATCCACCAATA
AATAAAGCTTCTGCAGAAAA

FIGURE 224

></usr/seqdb2/sst/DNA/Dnaseqs.min/ss.DNA76541
><subunit 1 of 1, 178 aa, 1 stop
><MW: 19600, pI: 5.89, NX(S/T): 1
MHRPEAMLLLLTLALLGGPTWAGKMYGPGGGKYFSTTEDYDHEITGLRVSVGLLLVKSVQVK
LGDSWDVKLGALGGNTQEVTLQPGEYITKVFVAFQAFLRGMVMYTSKDRYFYFGKLDGQISS
AYPSQEGQVLVGIYGQYQLLGIKSIGFEWNYPLEEPTTEPPVNLTYSANSPVGR

Signal peptide:
amino acids 1-22

FIGURE 225

```
GCTGAGCGTGTGCGCGGTACGGGGCTCTCCTGCCTTCTGGGCTCCAACGCAGCTCTGTGGCT
GAACTGGGTGCTCATCACGGGAACTGCTGGGCTATGGAATACAGATGTGGCAGCTCAGGTAG
CCCCAAATTGCCTGGAAGAATACATCATGTTTTTCGATAAGAAGAAATTGTAGGATCCAGTT
TTTTTTTTAACCGCCCCCTCCCCACCCCCCAAAAAAACTGTAAAGATGCAAAAACGTAATAT
CCATGAAGATCCTATTACCTAGGAAGATTTTGATGTTTTGCTGCGAATGCGGTGTTGGGATT
TATTTGTTCTTGGAGTGTTCTGCGTGGCTGGCAAAGAATAATGTTCCAAAATCGGTCCATCT
CCCAAGGGGTCCAATTTTTCTTCCTGGGTGTCAGCGAGCCCTGACTCACTACAGTGCAGCTG
ACAGGGGCTGTCATGCAACTGGCCCCTAAGCCAAAGCAAAAGACCTAAGGACGACCTTTGAA
CAATACAAAGGATGGGTTTCAATGTAATTAGGCTACTGAGCGGATCAGCTGTAGCACTGGTT
ATAGCCCCCACTGTCTTACTGACAATGCTTTCTTCTGCCGAACGAGGATGCCCTAAGGGCTG
TAGGTGTGAAGGCAAAATGGTATATTGTAATCTCAGAAATTACAGGAGATACCCTCAAGTA
TATCTGCTGGTTGCTTAGGTTTGTCCCTTCGCTATAACAGCCTTCAAAAACTTAAGTATAAT
CAATTTAAAGGGCTCAACCAGCTCACCTGGCTATACCTTGACCATAACCATATCAGCAATAT
TGACGAAAATGCTTTTAATGGAATACGCAGACTCAAAGAGCTGATTCTTAGTTCCAATAGAA
TCTCCTATTTTCTTAACAATACCTTCAGACCTGTGACAAATTTACGGAACTTGGATCTGTCC
TATAATCAGCTGCATTCTCTGGGATCTGAACAGTTTCGGGGCTTGCGGAAGCTGCTGAGTTT
ACATTTACGGTCTAACTCCCTGAGAACCATCCCTGTGCGAATATTCCAAGACTGCCGCAACC
TGGAACTTTTGGACCTGGGATATAACCGGATCCGAAGTTTAGCCAGGAATGTCTTTGCTGGC
ATGATCAGACTCAAAGAACTTCACCTGGAGCACAATCAATTTTCCAAGCTCAACCTGGCCCT
TTTTCCAAGGTTGGTCAGCCTTCAGAACCTTTACTTGCAGTGGAATAAAATCAGTGTCATAG
GACAGACCATGTCCTGGACCTGGAGCTCCTTACAAAGGCTTGATTTATCAGGCAATGAGATC
GAAGCTTTCAGTGGACCCAGTGTTTTCCAGTGTGTCCCGAATCTGCAGCGCCTCAACCTGGA
TTCCAACAAGCTCACATTTATTGGTCAAGAGATTTTGGATTCTTGGATATCCCTCAATGACA
TCAGTCTTGCTGGGAATATATGGGAATGCAGCAGAAATATTTGCTCCCTTGTAAACTGGCTG
AAAAGTTTTAAAGGTCTAAGGGAGAATACAATTATCTGTGCCAGTCCCAAAGAGCTGCAAGG
AGTAAATGTGATCGATGCAGTGAAGAACTACAGCATCTGTGGCAAAAGTACTACAGAGAGGT
TTGATCTGGCCAGGGCTCTCCCAAAGCCGACGTTTAAGCCCAAGCTCCCCAGGCCGAAGCAT
GAGAGCAAACCCCCTTTGCCCCCGACGGTGGGAGCCACAGAGCCCGGCCCAGAGACCGATGC
TGACGCCGAGCACATCTCTTTCCATAAAATCATCGCGGGCAGCGTGGCGCTTTTCCTGTCCG
TGCTCGTCATCCTGCTGGTTATCTACGTGTCATGGAAGCGGTACCCTGCGAGCATGAAGCAG
CTGCAGCAGCGCTCCCTCATGCGAAGGCACAGGAAAAGAAAAGACAGTCCCTAAAGCAAAT
GACTCCCAGCACCCAGGAATTTATGTAGATTATAAACCCACCAACACGGAGACCAGCGAGA
TGCTGCTGAATGGGACGGGACCCTGCACCTATAACAAATCGGGCTCCAGGGAGTGTGAGGTA
TGAACCATTGTGATAAAAGAGCTCTTAAAAGCTGGGAAATAAGTGGTGCTTTATTGAACTC
TGGTGACTATCAAGGGAACGCGATGCCCCCCCTCCCCTTCCCTCTCCCTCTCACTTTGGTGG
CAAGATCCTTCCTTGTCCGTTTTAGTGCATTCATAATACTGGTCATTTTCCTCTCATACATA
ATCAACCCATTGAAATTTAAATACCACAATCAATGTGAAGCTTGAACTCCGGTTTAATATAA
TACCTATTGTATAAGACCCTTTACTGATTCCATTAATGTCGCATTTGTTTAAGATAAAACT
TCTTTCATAGGTAAAAAAAAAAA
```

FIGURE 226

```
></usr/seqdb2/sst/DNA/Dnaseqs.min/ss.DNA77301
><subunit 1 of 1, 513 aa, 1 stop
><MW: 58266, pI: 9.84, NX(S/T): 4
MGFNVIRLLSGSAVALVIAPTVLLTMLSSAERGCPKGCRCEGKMVYCESQKLQEIPSSISAG
CLGLSLRYNSLQKLKYNQFKGLNQLTWLYLDHNHISNIDENAFNGIRRLKELILSSNRISYF
LNNTFRPVTNLRNLDLSYNQLHSLGSEQFRGLRKLLSLHLRSNSLRTIPVRIFQDCRNLELL
DLGYNRIRSLARNVFAGMIRLKELHLEHNQFSKLNLALFPRLVSLQNLYLQWNKISVIGQTM
SWTWSSLQRLDLSGNEIEAFSGPSVFQCVPNLQRLNLDSNKLTFIGQEILDSWISLNDISLA
GNIWECSRNICSLVNWLKSFKGLRENTIICASPKELQGVNVIDAVKNYSICGKSTTERFDLA
RALPKPTFKPKLPRPKHESKPPLPPTVGATEPGPETDADAEHISFHKIIAGSVALFLSVLVI
LLVIYVSWKRYPASMKQLQQRSLMRRHRKKKRQSLKQMTPSTQEFYVDYKPTNTETSEMLLN
GTGPCTYNKSGSRECEV
```

Important features of the protein:

Signal peptide:

amino acids 1-33

Transmembrane domain:

amino acids 420-442

N-glycosylation sites.

amino acids 126-129, 357-360, 496-499, 504-507 cAMP- and cGMP-dependent protein kinase phosphorylation site.

amino acids 465-468

Tyrosine kinase phosphorylation site.

amino acids 136-142

N-myristoylation sites.

amino acids 11-16, 33-38, 245-250, 332-337, 497-502, 507-512

FIGURE 227

```
AGTTCTGAGAAAGAAGGAAATAAACACAGGCACCAAACCACTATCCTAAGTTGACTGTCCTT
TAAATATGTCAAGATCCAGACTTTTCAGTGTCACCTCAGCGATCTCAACGATAGGGATCTTG
TGTTTGCCGCTATTCCAGTTGGTGCTCTCGGACCTACCATGCAAGAAGATGAAATGTGTGT
AAATTATAATGACCAACACCCTAATGGCTGGTATATCTGGATCCTCCTGCTGCTGGTTTTGG
TGGCAGCTCTTCTCTGTGGAGCTGTGGTCCTCTGCCTCCAGTGCTGGCTGAGGAGACCCCGA
ATTGATTCTCACAGGCGCACCATGGCAGTTTTTGCTGTTGGAGACTTGGACTCTATTTATGG
GACAGAAGCAGCTGTGAGTCCAACTGTTGGAATTCACCTTCAAACTCAAACCCCTGACCTAT
ATCCTGTTCCTGCTCCATGTTTTGGCCCTTTAGGCTCCCCACCTCCATATGAAGAAATTGTA
AAAACAACCTGATTTTAGGTGTGGATTATCAATTTAAAGTATTAACGACATCTGTAATTCCA
AAACATCAAATTTAGGAATAGTTATTTCAGTTGTTGGAAATGTCCAGAGATCTATTCATATA
GTCTGAGGAAGGACAATTCGACAAAAGAATGGATGTTGGAAAAAATTTTGGTCATGGAGATG
TTTAAATAGTAAAGTAGCAGGCTTTTGATGTGTCACTGCTGTATCATACTTTTATGCTACAC
AACCAAATTAATGCTTCTCCACTAGTATCCAAACAGGCAACAATTAGGTGCTGGAAGTAGTT
TCCATCACATTTAGGACTCCACTGCAGTATACAGCACACCATTTTCTGCTTTAAACTCTTTC
CTAGCATGGGGTCCATAAAAATTATTATAATTTAACAATAGCCCAAGCCGAGAATCCAACAT
GTCCAGAACCAGAACCAGAAAGATAGTATTTGAATGAAGGTGAGGGGAGAGAGTAGGAAAAA
GAAAAGTTTGGAGTTGAAGGGTAAAGGATAAATGAAGAGGAAAAGGAAAAGATTACAAGTCT
CAGCAAAAACAAGAGGTTTTATGCCCCAACCTGAAGAGGAAGAAATTGTAGATAGAAGGTGA
AGGAGATTGCTGAAGATATAGAGCACATATAATGCCAACACGGGGAGAAAAGAAAATTTCCC
CTTTTACAGTAATGAATGTGGCCTCCATAGTCCATAGTGTTTCTCTGGAGCCTCAGGGCTTG
GCATTTATTGCAGCATCATGCTAAGAACCTTCGGCATAGGTATCTGTTCCCATGAGGACTGC
AGAAGTAGCAATGAGACATCTTCAAGTGGCATTTTGGCAGTGGCCATCAGCAGGGGACAGA
CAAAACATCCATCACAGATGACATATGATCTTCAGCTGACAAATTTGTTGAACAAAACAAT
AAACATCAATAGATATCTAAAAA
```

FIGURE 228

```
></usr/seqdb2/sst/DNA/Dnaseqs.min/ss.DNA77303
><subunit 1 of 1, 146 aa, 1 stop
><MW: 16116, pI: 4.99, NX(S/T): 0
MSRSRLFSVTSAISTIGILCLPLFQLVLSDLPCEEDEMCVNYNDQHPNGWYIWILLLLVLVA
ALLCGAVVLCLQCWLRRPRIDSHRRTMAVFAVGDLDSIYGTEAAVSPTVGIHLQTQTPDLYP
VPAPCFGPLGSPPPYEEIVKTT
```

Signal peptide:

amino acids 1-29

Transmembrane domain:

amino acids 52-70

FIGURE 229

```
GAGCGGAGTAAAATCTCCACAAGCTGGGAACAAACCTCGTCCCAACTCCCACCCACCGGCGT
TTCTCCAGCTCGATCTGGAGGCTGCTTCGCCAGTGTGGGACGCAGCTGACGCCCGCTTATTA
GCTCTCGCTGCGTCGCCCCGGCTCAGAAGCTCCGTGGCGGCGGCGACCGTGACGAGAAGCCC
ACGGCCAGCTCAGTTCTCTTCTACTTTGGGAGAGAGAGAAAGTCAGATGCCCCTTTTAAACT
CCCTCTTCAAAACTCATCTCCTGGGTGACTGAGTTAATAGAGTGGATACAACCTTGCTGAAG
ATGAAGAATATACAATATTGAGGATATTTTTTCTTTTTTTTTCAAGTCTTGATTTGTGGC
TTACCTCAAGTTACCATTTTTCAGTCAAGTCTGTTTGTTTGCTTCTTCAGAAATGTTTTTA
CAATCTCAAGAAAAATATGTCCCAGAAATTGAGTTTACTGTTGCTTGTATTTGGACTCATT
TGGGGATTGATGTTACTGCACTATACTTTTCAACAACCAAGACATCAAAGCAGTGTCAAGTT
ACGTGAGCAAATACTAGACTTAAGCAAAAGATATGTTAAAGCTCTAGCAGAGGAAAATAAGA
ACACAGTGGATGTCGAGAACGGTGCTTCTATGGCAGGATATGCGGATCTGAAAAGAACAATT
GCTGTCCTTCTGGATGACATTTTGCAACGATTGGTGAAGCTGGAGAACAAAGTTGACTATAT
TGTTGTGAATGGCTCAGCAGCCAACACCACCAATGGTACTAGTGGGAATTGGTGCCAGTAA
CCACAAATAAAAGAACGAATGTCTCGGGCAGTATCAGATAGCAGTTGAAAATCACCTTGTGC
TGCTCCATCCACTGTGGATTATATCCTATGGCAGAAAAGCTTTATAATTGCTGGCTTAGGAC
AGAGCAATACTTTACAATAAAAGCTCTACACATTTTCAAGGAGTATGCTGGATTCATGGAAC
TCTAATTCTGTACATAAAAATTTTAAAGTTATTTGTTTGCTTTCAGGCAAGTCTGTTCAATG
CTGTACTATGTCCTTAAAGAGAATTTGGTAACTTGGTTGATGTGGTAAGCAGATAGGTGAGT
TTTGTATAAATCTTTTGTGTTTGAGATCAAGCTGAAATGAAAACACTGAAAAACATGGATTC
ATTTCTATAACACATTTATTTAAGTATATAACACGTTTTTGGACAAGTGAAGAATGTTTAA
TCATTCTGTCATTTGTTCTCAATAGATGTAACTGTTAGACTACGGCTATTTGAAAAAATGTG
CTTATTGTACTATATTTTGTTATTCCAATTATGAGCAGAGAAAGGAAATATAATGTTGAAAA
TAATGTTTTGAAATCATGACCCAAAGAATGTATTGATTTGCACTATCCTTCAGAATAACTGA
AGGTTAATTATTGTATATTTTAAAAATTACACTTATAAGAGTATAATCTTGAAATGGGTAG
CAGCCACTGTCCATTACCTATCGTAAACATTGGGGCAATTTAATAACAGCATTAAAATAGTT
GTAAACTCTAATCTTATACTTATTGAAGAATAAAAGATATTTTATGATGAGAGTAACAATA
AAGTATTCATGATTTTCACATACATGAATGTTCATTTAAAAGTTTAATCCTTTGAGTGTCT
ATGCTATCAGGAAAGCACATTATTTCCATATTTGGGTTAATTTTGCTTTTATTATATTGGTC
TAGGAGGAAGGGACTTTGGAGAATGGAACTCTTGAGGACTTTAGCCAGGTGTATATAATAAA
GGTACTTTTGTGCTGCATTAAATTGCTTGGAAAGTGTTAACATTATATTATATAAGAGTATC
CTTTATGAAATTTTGAATTTGTATAACAGATGCATTAGATATTCATTTTATATAATGGCCAC
TTAAAATAAGAACATTTAAAATATAAACTATGAAGATTGACTATCTTTTCAGGAAAAAGCT
GTATATAGCACAGGGAACCCTAATCTTGGGTAATTCTAGTATAAAACAAATTATACTTTTAT
TTAAATTTCCCTTGTAGCAAATCTAATTGCCACATGGTGCCCTATATTTCATAGTATTTATT
CTCTATAGTAACTGCTTAAGTGCAGCTAGCTTCTAGATTTAGACTATATAGAATTTAGATAT
TGTATTGTTCGTCATTATAATATGCTACCACATGTAGCAATAATTACAATATTTATTAAAA
TAAATATGTGAAATATTGTTTCATGAAAGACAGATTTCCAAATCTCTCTTCTCTTCTCTGTA
CTGTCTACCTTTATGTGAAGAAATTAATTATATGCCATTGCCAGGT
```

FIGURE 230

```
></usr/seqdb2/sst/DNA/Dnaseqs.min/ss.DNA77648
><subunit 1 of 1, 140 aa, 1 stop
><MW: 15668, pI: 10.14, NX(S/T): 5
MFFTISRKNMSQKLSLLLLVFGLIWGLMLLHYTFQQPRHQSSVKLREQILDLSKRYVKALAE
ENKNTVDVENGASMAGYADLKRTIAVLLDDILQRLVKLENKVDYIVVNGSAANTTNGTSGNL
VPVTTNKRTNVSGSIR
```

Important features of the protein:

Signal peptide:

amino acids 1-26

FIGURE 231

```
CGCGGCCGGGCCGCCGGGGTGAGCGTGCCGAGGCGGCTGTGGCGCAGGCTTCCAGCCCCAC
CATGCCGTGGCCCCTGCTGCTGCTGCTGGCCGTGAGTGGGGCCCAGACAACCCGGCCATGCT
TCCCCGGGTGCCAATGCGAGGTGGAGACCTTCGGCCTTTTCGACAGCTTCAGCCTGACTCGG
GTGGATTGTAGCGGCCTGGGCCCCCACATCATGCCGGTGCCCATCCCTCTGGACACAGCCCA
CTTGGACCTGTCCTCCAACCGGCTGGAGATGGTGAATGAGTCGGTGTTGGCGGGGCCGGGCT
ACACGACGTTGGCTGGCCTGGATCTCAGCCACAACCTGCTCACCAGCATCTCACCCACTGCC
TTCTCCCGCCTTCGCTACCTGGAGTCGCTTGACCTCAGCCACAATGGCCTGACAGCCCTGCC
AGCCGAGAGCTTCACCAGCTCACCCCTGAGCGACGTGAACCTTAGCCACAACCAGCTCCGGG
AGGTCTCAGTGTCTGCCTTCACGACGCACAGTCAGGGCCGGGCACTACACGTGGACCTCTCC
CACAACCTCATTCACCGCCTCGTGCCCCACCCCACGAGGGCCGGCCTGCCTGCGCCCACCAT
TCAGAGCCTGAACCTGGCCTGGAACCGGCTCCATGCCGTGCCCAACCTCCGAGACTTGCCCC
TGCGCTACCTGAGCCTGGATGGGAACCCTCTAGCTGTCATTGGTCCGGGTGCCTTCGCGGGG
CTGGGAGGCCTTACACACCTGTCTCTGGCCAGCCTGCAGAGGCTCCCTGAGCTGGCGCCCAG
TGGCTTCCGTGAGCTACCGGGCCTGCAGGTCCTGGACCTGTCGGGCAACCCCAAGCTTAACT
GGGCAGGAGCTGAGGTGTTTTCAGGCCTGAGCTCCCTGCAGGAGCTGGACCTTTCGGGCACC
AACCTGGTGCCCCTGCCTGAGGCGCTGCTCCTCCACCTCCCGGCACTGCAGAGCGTCAGCGT
GGGCCAGGATGTGCGGTGCCGGCGCCTGGTGCGGGAGGGCACCTACCCCCGGAGGCCTGGCT
CCAGCCCCAAGGTGCCCCTGCACTGCGTAGACACCCGGGAATCTGCTGCCAGGGGCCCCACC
ATCTTGTGACAAATGGTGTGGCCCAGGGCCACATAACAGACTGCTGTCCTGGGCTGCCTCAG
GTCCCGAGTAACTTATGTTCAATGTGCCAACACCAGTGGGGAGCCCGCAGGCCTATGTGGCA
GCGTCACCACAGGAGTTGTGGGCCTAGGAGAGGCTTTGGACCTGGGAGCCACACCTAGGAGC
AAAGTCTCACCCCTTTGTCTACGTTGCTTCCCCAAACCATGAGCAGAGGGACTTCGATGCCA
AACCAGACTCGGGTCCCCTCCTGCTTCCCTTCCCCACTTATCCCCCAAGTGCCTTCCCTCAT
GCCTGGGCCGGCCTGACCCGCAATGGGCAGAGGGTGGGTGGGACCCCCTGCTGCAGGGCAGA
GTTCAGGTCCACTGGGCTGAGTGTCCCCTTGGGCCCATGGCCCAGTCACTCAGGGGCGAGTT
TCTTTTCTAACATAGCCCTTTCTTTGCCATGAGGCCATGAGGCCCGCTTCATCCTTTTCTAT
TTCCCTAGAACCTTAATGGTAGAAGGAATTGCAAAGAATCAAGTCCACCCTTCTCATGTGAC
AGATGGGGAAACTGAGGCCTTGAGAAGGAAAAAGGCTAATCTAAGTTCCTGCGGGCAGTGGC
ATGACTGGAGCACAGCCTCCTGCCTCCCAGCCCGGACCCAATGCACTTTCTTGTCTCCTCTA
ATAAGCCCCACCCTCCCCGCCTGGGCTCCCCTTGCTGCCCTTGCCTGTTCCCCATTAGCACA
GGAGTAGCAGCAGCAGGACAGGCAAGAGCCTCACAAGTGGGACTCTGGGCCTCTGACCAGCT
GTGCGGCATGGGCTAAGTCACTCTGCCCTTCGGAGCCTCTGGAAGCTTAGGGCACATTGGTT
CCAGCCTAGCCAGTTTCTCACCCTGGGTTGGGGTCCCCAGCATCCAGACTGGAAACCTACC
CATTTTCCCCTGAGCATCCTCTAGATGCTGCCCCAAGGAGTTGCTGCAGTTCTGGAGCCTCA
TCTGGCTGGGATCTCCAAGGGGCCTCCTGGATTCAGTCCCCACTGGCCCTGAGCACGACAGC
CCTTCTTACCCTCCCAGGAATGCCGTGAAAGGAGACAAGGTCTGCCCGACCCATGTCTATGC
TCTACCCCCAGGGCAGCATCTCAGCTTCCGAACCCTGGGCTGTTTCCTTAGTCTTCATTTTA
TAAAAGTTGTTGCCTTTTAACGGAGTGTCACTTTCAACCGGCCTCCCCTACCCCTGCTGGC
CGGGGATGGAGACATGTCATTTGTAAAAGCAGAAAAGGTTGCATTTGTTCACTTTTGTAAT
ATTGTCCTGGGCCTGTGTTGGGGTGTTGGGGGAAGCTGGGCATCAGTGGCCACATGGGCATC
AGGGGCTGGCCCCACAGAGACCCCACAGGGCAGTGAGCTCTGTCTTCCCCACCTGCCTAGC
CCATCATCTATCTAACCGGTCCTTGATTTAATAAACACTATAAAAGGTTTAAAAAAAAAAA
AAAAAAAAAAAAAAAAAAAAAAAAAAAAAAA
```

FIGURE 232

```
></usr/seqdb2/sst/DNA/Dnaseqs.min/ss.DNA77652
><subunit 1 of 1, 353 aa, 1 stop
><MW: 37847, pI: 6.80, NX(S/T): 2
MPWPLLLLLAVSGAQTTRPCFPGCQCEVETFGLFDSFSLTRVDCSGLGPHIMPVPIPLDTAH
LDLSSNRLEMVNESVLAGPGYTTLAGLDLSHNLLTSISPTAFSRLRYLESLDLSHNGLTALP
AESFTSSPLSDVNLSHNQLREVSVSAFTTHSQGRALHVDLSHNLIHRLVPHPTRAGLPAPTI
QSLNLAWNRLHAVPNLRDLPLRYLSLDGNPLAVIGPGAFAGLGGLTHLSLASLQRLPELAPS
GFRELPGLQVLDLSGNPKLNWAGAEVFSGLSSLQELDLSGTNLVPLPEALLLHLPALQSVSV
GQDVRCRRLVREGTYPRRPGSSPKVPLHCVDTRESAARGPTIL
```

Signal peptide:

amino acids 1-16

Transmembrane domains:

amino acids 215-232, 287-304

FIGURE 233

GATGGCGCAGCCACAGCTTCTGTGAGATTCGATTTCTCCCCAGTTCCCCTGTGGGTCTGAGG
GGACCAGAAGGGTGAGCTACGTTGGCTTTCTGGAAGGGGAGGCTATATGCGTCAATTCCCCA
AAACAAGTTTTGACATTTCCCCTGAAATGTCATTCTCTATCTATTCACTGCAAGTGCCTGCT
GTTCCAGGCCTTACCTGCTGGGCACTAACGGCGGAGCCAGGATGGGGACAGAATAAAGGAGC
CACGACCTGTGCCACCAACTCGCACTCAGACTCTGAACTCAGACCTGAAATCTTCTCTTCAC
GGGAGGCTTGGCAGTTTTTCTTACTCCTGTGGTCTCCAGATTTCAGGCCTAAGATGAAAGCC
TCTAGTCTTGCCTTCAGCCTTCTCTCTGCTGCGTTTTATCTCCTATGGACTCCTTCCACTGG
ACTGAAGACACTCAATTTGGGAAGCTGTGTGATCGCCACAAACCTTCAGGAAATACGAAATG
GATTTTCTGAGATACGGGGCAGTGTGCAAGCCAAAGATGGAAACATTGACATCAGAATCTTA
AGGAGGACTGAGTCTTTGCAAGACACAAAGCCTGCGAATCGATGCTGCCTCCTGCGCCATTT
GCTAAGACTCTATCTGGACAGGGTATTTAAAAACTACCAGACCCCTGACCATTATACTCTCC
GGAAGATCAGCAGCCTCGCCAATTCCTTTCTTACCATCAAGAAGGACCTCCGGCTCTCAT
GCCCACATGACATGCCATTGTGGGGAGGAAGCAATGAAGAAATACAGCCAGATTCTGAGTCA
CTTTGAAAAGCTGGAACCTCAGGCAGCAGTTGTGAAGGCTTTGGGGGAACTAGACATTCTTC
TGCAATGGATGGAGGAGACAGAATAGGAGGAAAGTGATGCTGCTGCTAAGAATATTCGAGGT
CAAGAGCTCCAGTCTTCAATACCTGCAGAGGAGGCATGACCCCAAACCACCATCTCTTTACT
GTACTAGTCTTGTGCTGGTCACAGTGTATCTTATTTATGCATTACTTGCTTCCTTGCATGAT
TGTCTTTATGCATCCCCAATCTTAATTGAGACCATACTTGTATAAGATTTTGTAATATCTT
TCTGCTATTGGATATATTTATTAGTTAATATATTTATTTATTTTTGCTATTTAATGTATTT
ATTTTTTACTTGGACATGAAACTTTAAAAAAATTCACAGATTATATTTATAACCTGACTAG
AGCAGGTGATGTATTTTTATACAGTAAAAAAAAAAAACCTTGTAAATTCTAGAAGAGTGGCT
AGGGGGGTTATTCATTTGTATTCAACTAAGGACATATTTACTCATGCTGATGCTCTGTGAGA
TATTTGAAATTGAACCAATGACTACTTAGGATGGGTTGTGGAATAAGTTTTGATGTGGAATT
GCACATCTACCTTACAATTACTGACCATCCCCAGTAGACTCCCCAGTCCCATAATTGTGTAT
CTTCCAGCCAGGAATCCTACACGGCCAGCATGTATTTCTACAAATAAAGTTTTCTTTGCATA
CCAAAAAAAAAAAAAAAAAA

FIGURE 234

></usr/seqdb2/sst/DNA/Dnaseqs.min/ss.DNA83500
><subunit 1 of 1, 261 aa, 1 stop
><MW: 29667, pI: 8.76, NX(S/T): 0
MRQFPKTSFDISPEMSFSIYSLQVPAVPGLTCWALTAEPGWGQNKGATTCATNSHSDSELRP
EIFSSREAWQFFLLLWSPDFRPKMKASSLAFSLLSAAFYLLWTPSTGLKTLNLGSCVIATNL
QEIRNGFSEIRGSVQAKDGNIDIRILRRTESLQDTKPANRCCLLRHLLRLYLDRVFKNYQTP
DHYTLRKISSLANSFLTIKKDLRLSHAHMTCHCGEEAMKKYSQILSHFEKLEPQAAVVKALG
ELDILLQWMEETE Important features of the protein:
Signal peptide:
amino acids 1-42 cAMP- and cGMP-dependent protein kinase phosphorylation sites.
amino acids 192-195, 225-228

N-myristoylation sites.
amino acids 42-47, 46-51, 136-141

FIGURE 235

CCGTTATCGTCTTGCGCTACTGCTGAATGTCCGTCCCGGAGGAGGAGGAGAGGCTTTTGCCG
CTGACCCAGAGATGGCCCCGAGCGAGCAAATTCCTACTGTCCGGCTGCGCGGCTACCGTGGC
CGAGCTAGCAACCTTTCCCCTGGATCTCACAAAAACTCGACTCCAAATGCAAGGAGAAGCAG
CTCTTGCTCGGTTGGGAGACGGTGCAAGAGAATCTGCCCCCTATAGGGGAATGGTGCGCACA
GCCCTAGGGATCATTGAAGAGGAAGGCTTTCTAAAGCTTTGGCAAGGAGTGACACCCGCCAT
TTACAGACACGTAGTGTATTCTGGAGGTCGAATGGTCACATATGAACATCTCCGAGAGGTTG
TGTTTGGCAAAAGTGAAGATGAGCATTATCCCCTTTGGAAATCAGTCATTGGAGGGATGATG
GCTGGTGTTATTGGCCAGTTTTTAGCCAATCCAACTGACCTAGTGAAGGTTCAGATGCAAAT
GGAAGGAAAAAGGAAACTGGAAGGAAAACCATTGCGATTTCGTGGTGTACATCATGCATTTG
CAAAAATCTTAGCTGAAGGAGGAATACGAGGGCTTTGGGCAGGCTGGGTACCCAATATACAA
AGAGCAGCACTGGTGAATATGGGAGATTTAACCACTTATGATACAGTGAAACACTACTTGGT
ATTGAATACACCACTTGAGGACAATATCATGACTCACGGTTTATCAAGTTTATGTTCTGGAC
TGGTAGCTTCTATTCTGGGAACACCAGCCGATGTCATCAAAAGCAGAATAATGAATCAACCA
CGAGATAAACAAGGAAGGGGACTTTTGTATAAATCATCGACTGACTGCTTGATTCAGGCTGT
TCAAGGTGAAGGATTCATGAGTCTATATAAAGGCTTTTTACCATCTTGGCTGAGAATGACCC
CTTGGTCAATGGTGTTCTGGCTTACTTATGAAAAAATCAGAGAGATGAGTGGAGTCAGTCCA
TTTTAA

FIGURE 236

></usr/seqdb2/sst/DNA/Dnaseqs.min/ss.DNA77568
><subunit 1 of 1, 323 aa, 1 stop
><MW: 36064, pI: 9.33, NX(S/T): 1
MSVPEEEERLLPLTQRWPRASKFLLSGCAATVAELATFPLDLTKTRLQMQGEAALARLGDGA
RESAPYRGMVRTALGIIEEEGFLKLWQGVTPAIYRHVVYSGGRMVTYEHLREVVFGKSEDEH
YPLWKSVIGGMMAGVIGQFLANPTDLVKVQMQMEGKRKLEGKPLRFRGVHHAFAKILAEGGI
RGLWAGWVPNIQRAALVNMGDLTTYDTVKHYLVLNTPLEDNIMTHGLSSLCSGLVASILGTP
ADVIKSRIMNQPRDKQGRGLLYKSSTDCLIQAVQGEGFMSLYKGFLPSWLRMTPWSMVFWLT
YEKIREMSGVSPF

Transmembrane domains:
amino acids 25-38, 130-147, 233-248

FIGURE 237

CGGACGCGTGGGCGCGGGACGCCGGCAGGGTTGTGGCGCAGCAGTCTCCTTCCTGCGCGCGC
GCCTGAAGTCGGCGTGGGCGTTTGAGGAAGCTGGGATACAGCATTTAATGAAAAATTTATGC
TTAAGAAGTAAAAATGGCAGGCTTCCTAGATAATTTTCGTTGGCCAGAATGTGAATGTATTG
ACTGGAGTGAGAGAAGAAATGCTGTGGCATCTGTTGTCGCAGGTATATTGTTTTTTACAGGC
TGGTGGATAATGATTGATGCAGCTGTGGTGTATCCTAAGCCAGAACAGTTGAACCATGCCTT
TCACACATGTGGTGTATTTTCCACATTGGCTTTCTTCATGATAAATGCTGTATCCAATGCTC
AGGTGAGAGGTGATAGCTATGAAAGCGGCTGTTTAGGAAGAACAGGTGCTCGAGTTTGGCTT
TTCATTGGTTTCATGTTGATGTTTGGGTCACTTATTGCTTCCATGTGGATTCTTTTGGTGC
ATATGTTACCCAAAATACTGATGTTTATCCGGGACTAGCTGTGTTTTTCAAAATGCACTTA
TATTTTTAGCACTCTGATCTACAAATTTGGAAGAACCGAAGAGCTATGGACCTGAGATCAC
TTCTTAAGTCACATTTTCCTTTTGTTATATTCTGTTTGTAGATAGGTTTTTTATCTCTCAGT
ACACATTGCCAAATGGAGTAGATTGTACATTAAATGTTTTGTTTCTTTACATTTTTATGTTC
TGAGTTTTGAAATAGTTTTATGAAATTTCTTTATTTTTCATTGCATAGACTGTTAATATGTA
TATAATACAAGACTATATGAATTGGATAATGAGTATCAGTTTTTTATTCCTGAGATTTAGAA
CTTGATCTACTCCCTGAGCCAGGGTTACATCATCTTGTCATTTTAGAAGTAACCACTCTTGT
CTCTCTGGCTGGGCACGGTGGCTCATGCCTGTAATCCCAGCACTTTGGGAGGCCGAGGCGGG
CCGATTGCTTGAGGTCAAGTGTTTGAGACCAGCCTGGCCAACATGGCGAAACCCCATCTACT
AAAAATACAAAAATTAGCCAGGCATGGTGGTGGGTGCCTGTAATCCCAGCTACCTGGGAGGC
TGAGGCAGGAGAATCGCTTGAACCCGGGGGGCAGAGGTTGCAGTGAGCTGAGTTTGCGCCAC
TGCACTCTAGCCTGGGGGAGAAAGTGAAACTCCCTCTCAAAAAAAGACCACTCTCAGTATC
TCTGATTTCTGAAGATGTACAAAAAAATATAGCTTCATATATCTGGAATGAGCACTGAGCCA
TAAAAGGTTTTCAGCAAGTTGTAACTTATTTTGGCCTAAAAATGAGGTTTTTTGGTAAAGA
AAAAATATTTGTTCTTATGTATTGAAGAAGTGTACTTTTATATAATGATTTTTTAAATGCCC
AAAGGACTAGTTTGAAAGCTTCTTTTAAAAAGAATTCCTCTAATATGACTTTATGTGAGAA

FIGURE 238

MAGFLDNFRWPECECIDWSERRNAVASVVAGILFFTGWWIMIDAAVVYPKPEQLNHAFHTCG
VFSTLAFFMINAVSNAQVRGDSYESGCLGRTGARVWLFIGFMLMFGSLIASMWILFGAYVTQ
NTDVYPGLAVFFQNALIFFSTLIYKFGRTEELWT

Important features:

Signal peptide:

amino acids 1-44

Transmembrane domains:

amino acids 23-42 (type II), 60-80, 97-117, 128-148

FIGURE 239

GTTGATGGCAAACTTCCTCAAAGGAGGGGCAGAGCCTGCGCAGGGCAGGAGCAGCTGGCCCA
CTGGCGGCCCGCAACACTCCGTCTCACCCTCTGGGCCCACTGCATCTAGAGGAGGGCCGTCT
GTGAGGCCACTACCCCTCCAGCAACTGGGAGGTGGGACTGTCAGAAGCTGGCCCAGGGTGGT
GGTCAGCTGGGTCAGGGACCTACGGCACCTGCTGGACCACCTCGCCTTCTCCATCGAAGCAG
GGAAGTGGGAGCCTCGAGCCCTCGGGTGGAAGCTGACCCCAAGCCACCCTTCACCTGGACAG
GATGAGAGTGTCAGGTGTGCTTCGCCTCCTGGCCCTCATCTTTGCCATAGTCACGACATGGA
TGTTTATTCGAAGCTACATGAGCTTCAGCATGAAAACCATCCGTCTGCCACGCTGGCTGGCA
GCCTCGCCCACCAAGGAGATCCAGGTTAAAAAGTACAAGTGTGGCCTCATCAAGCCCTGCCC
AGCCAACTACTTTGCGTTTAAAATCTGCAGTGGGGCCGCCAACGTCGTGGGCCCTACTATGT
GCTTTGAAGACCGCATGATCATGAGTCCTGTGAAAAACAATGTGGGCAGAGGCCTAAACATC
GCCCTGGTGAATGGAACCACGGGAGCTGTGCTGGGACAGAAGGCATTTGACATGTACTCTGG
AGATGTTATGCACCTAGTGAAATTCCTTAAAGAAATTCCGGGGGGTGCACTGGTGCTGGTGG
CCTCCTACGACGATCCAGGGACCAAAATGAACGATGAAAGCAGGAAACTCTTCTCTGACTTG
GGGAGTTCCTACGCAAAACAACTGGGCTTCCGGGACAGCTGGGTCTTCATAGGAGCCAAAGA
CCTCAGGGGTAAAAGCCCCTTTGAGCAGTTCTTAAAGAACAGCCCAGACACAAACAAATACG
AGGGATGGCCAGAGCTGCTGGAGATGGAGGGCTGCATGCCCCGAAGCCATTTTAGGGTGGC
TGTGGCTCTTCCTCAGCCAGGGGCCTGAAGAAGCTCCTGCCTGACTTAGGAGTCAGAGCCCG
GCAGGGGCTGAGGAGGAGGAGCAGGGGGTGCTGCGTGGAAGGTGCTGCAGGTCCTTGCACGC
TGTGTCGCGCCTCTCCTCCTCGGAAACAGAACCCTCCCACAGCACATCCTACCCGGAAGACC
AGCCTCAGAGGGTCCTTCTGGAACCAGCTGTCTGTGGAGAGAATGGGGTGCTTTCGTCAGGG
ACTGCTGACGGCTGGTCCTGAGGAAGGACAAACTGCCCAGACTTGAGCCCAATTAAATTTTA
TTTTTGCTGGTTTTGAAAAAAAAAAAAAAAAAAAA

FIGURE 240

</usr/seqdb2/sst/DNA/Dnaseqs.min/ss.DNA59814
<subunit 1 of 1, 224 aa, 1 stop
<MW: 24963, pI: 9.64, NX(S/T): 1
MRVSGVLRLLALIFAIVTTWMFIRSYMSFSMKTIRLPRWLAASPTKEIQVKKYKCGLIKPCP
ANYFAFKICSGAANVVGPTMCFEDRMIMSPVKNNVGRGLNIALVNGTTGAVLGQKAFDMYSG
DVMHLVKFLKEIPGGALVLVASYDDPGTKMNDESRKLFSDLGSSYAKQLGFRDSWVFIGAKD
LRGKSPFEQFLKNSPDTNKYEGWPELLEMEGCMPPKPF

Important features:

Signal peptide:

amino acids 1-15

ATP/GTP-binding site motif A (P-loop).

amino acids 184-191

N-glycosylation site.

amino acids 107-110

FIGURE 241

GAGACTGCAGAGGGAGATAAAGAGAGAGGGCAAAGAGGCAGCAAGAGATTTGTCCTGGGGAT
CCAGAAACCCATGATACCCTACTGAACACCGAATCCCTGGAAGCCCACAGAGACAGAGACA
GCAAGAGAAGCAGAGATAAATACACTCACGCCAGGAGCTCGCTCGCTCTCTCTCTCTCTC
TCACTCCTCCCTCCCTCTCTCTCTGCCTGTCCTAGTCCTCTAGTCCTCAAATTCCCAGTCCC
CTGCACCCCTTCCTGGGACACTATGTTGTTCTCCGCCCTCCTGCTGGAGGTGATTTGGATCC
TGGCTGCAGATGGGGGTCAACACTGGACGTATGAGGGCCCACATGGTCAGGACCATTGGCCA
GCCTCTTACCCTGAGTGTGGAAACAATGCCCAGTCGCCCATCGATATTCAGACAGACAGTGT
GACATTTGACCCTGATTTGCCTGCTCTGCAGCCCCACGGATATGACCAGCCTGGCACCGAGC
CTTTGGACCTGCACAACAATGGCCACACAGTGCAACTCTCTCTGCCCTCTACCCTGTATCTG
GGTGGACTTCCCCGAAAATATGTAGCTGCCCAGCTCCACCTGCACTGGGGTCAGAAAGGATC
CCCAGGGGGGTCAGAACACCAGATCAACAGTGAAGCCACATTTGCAGAGCTCCACATTGTAC
ATTATGACTCTGATTCCTATGACAGCTTGAGTGAGGCTGCTGAGAGGCCTCAGGGCCTGGCT
GTCCTGGGCATCCTAATTGAGGTGGGTGAGACTAAGAATATAGCTTATGAACACATTCTGAG
TCACTTGCATGAAGTCAGGCATAAAGATCAGAAGACCTCAGTGCCTCCCTTCAACCTAAGAG
AGCTGCTCCCCAAACAGCTGGGGCAGTACTTCCGCTACAATGGCTCGCTCACAACTCCCCCT
TGCTACCAGAGTGTGCTCTGGACAGTTTTTTATAGAAGGTCCCAGATTTCAATGGAACAGCT
GGAAAAGCTTCAGGGGACATTGTTCTCCACAGAAGAGGAGCCCTCTAAGCTTCTGGTACAGA
ACTACCGAGCCCTTCAGCCTCTCAATCAGCGCATGGTCTTTGCTTCTTTCATCCAAGCAGGA
TCCTCGTATACCACAGGTGAAATGCTGAGTCTAGGTGTAGGAATCTTGGTTGGCTGTCTCTG
CCTTCTCCTGGCTGTTTATTTCATTGCTAGAAAGATTCGGAAGAAGAGGCTGGAAAACCGAA
AGAGTGTGGTCTTCACCTCAGCACAAGCCACGACTGAGGCATAAATTCCTTCTCAGATACCA
TGGATGTGGATGACTTCCCTTCATGCCTATCAGGAAGCCTCTAAAATGGGGTGTAGGATCTG
GCCAGAAACACTGTAGGAGTAGTAAGCAGATGTCCTCCTTCCCCTGGACATCTCTTAGAGAG
GAATGGACCCAGGCTGTCATTCCAGGAAGAACTGCAGAGCCTTCAGCCTCTCCAAACATGTA
GGAGGAAATGAGGAAATCGCTGTGTTGTTAATGCAGAGANCAAACTCTGTTTAGTTGCAGGG
GAAGTTTGGGATATACCCCAAAGTCCTCTACCCCCTCACTTTTATGGCCCTTTCCCTAGATA
TACTGCGGGATCTCTCCTTAGGATAAAGAGTTGCTGTTGAAGTTGTATATTTTTGATCAATA
TATTTGGAAATTAAAGTTTCTGACTTT

FIGURE 242

```
></usr/seqdb2/sst/DNA/Dnaseqs.min/ss.DNA62812
><subunit 1 of 1, 337 aa, 1 stop
><MW: 37668, pI: 6.27, NX(S/T): 1
MLFSALLLEVIWILAADGGQHWTYEGPHGQDHWPASYPECGNNAQSPIDIQTDSVTFDPDLP
ALQPHGYDQPGTEPLDLHNNGHTVQLSLPSTLYLGGLPRKYVAAQLHLHWGQKGSPGGSEHQ
INSEATFAELHIVHYDSDSYDSLSEAAERPQGLAVLGILIEVGETKNIAYEHILSHLHEVRH
KDQKTSVPPFNLRELLPKQLGQYFRYNGSLTTPPCYQSVLWTVFYRRSQISMEQLEKLQGTL
FSTEEEPSKLLVQNYRALQPLNQRMVFASFIQAGSSYTTGEMLSLGVGILVGCLCLLLAVYF
IARKIRKKRLENRKSVVFTSAQATTEA
```

Important features of the protein:

Signal peptide:

amino acids 1-15

Transmembrane domain:

amino acids 291-310

N-glycosylation site.

amino acids 213-216

Eukaryotic-type carbonic anhydrases proteins amino acids 197-245, 104-140, 22-69

FIGURE 243

AATTTTTCACCAGAGTAAACTTGAGAAACCAACTGGACCTTGAGTATTGTACATTTTGCCTC
GTGGACCCAAAGGTAGCAATCTGAAACATGAGGAGTACGATTCTACTGTTTTGTCTTCTAGG
ATCAACTCGGTCATTACCACAGCTCAAACCTGCTTTGGGACTCCCTCCCACAAAACTGGCTC
CGGATCAGGGAACACTACCAAACCAACAGCAGTCAAATCAGGTCTTTCCTTCTTTAAGTCTG
ATACCATTAACACAGATGCTCACACTGGGGCCAGATCTGCATCTGTTAAATCCTGCTGCAGG
AATGACACCTGGTACCAGACCCACCCATTGACCCTGGGAGGGTTGAATGTACAACAGCAAC
TGCACCCACATGTGTTACCATTTTTGTCACACAACTTGGAGCCCAGGGCACTATCCTAAGC
TCAGAGGAATTGCCACAAATCTTCACGAGCCTCATCATCCATTCCTTGTTCCCGGGAGGCAT
CCTGCCCACCAGTCAGGCAGGGCTAATCCAGATGTCCAGGATGGAAGCCTTCCAGCAGGAG
GAGCAGGTGTAAATCCTGCCACCCAGGGAACCCCAGCAGGCCGCCTCCCAACTCCCAGTGGC
ACAGATGACGACTTTGCAGTGACCACCCCTGCAGGCATCCAAAGGAGCACACATGCCATCGA
GGAAGCCACCACAGAATCAGCAAATGGAATTCAGTAAGCTGTTTCAAATTTTTTCAACTAAG
CTGCCTCGAATTTGGTGATACATGTGAATCTTTATCATTGATTATATTATGGAATAGATTGA
GACACATTGGATAGTCTTAGAAGAAATTAATTCTTAATTTACCTGAAAATATTCTTGAAATT
TCAGAAAATATGTTCTATGTAGAGAATCCCAACTTTTAAAAACAATAATTCAATGGATAAAT
CTGTCTTTGAAATATAACATTATGCTGCCTGGATGATATGCATATTAAAACATATTTGGAAA
ACTGGAAAAAAAAAAAAAAAAAAAAAAAAAAAAAAAAAAAAAAAAAAAAAAAAAAAAAAAA
AAAAAAAAAAAAAAAAAA

FIGURE 244

MRSTILLFCLLGSTRSLPQLKPALGLPPTKLAPDQGTLPNQQQSNQVFPSLSLIPLTQM
LTLGPDLHLLNPAAGMTPGTQTHPLTLGGLNVQQQLHPHVLPIFVTQLGAQGTILSSEE
LPQIFTSLIIHSLFPGGILPTSQAGANPDVQDGSLPAGGAGVNPATQGTPAGRLPTPSG
TDDDFAVTTPAGIQRSTHAIEEATTESANGIQ

Signal peptide:
amino acids 1-16

FIGURE 245

GGAGAGAGGCGCGCGGGTGAAAGGCGCATTGATGCAGCCTGCGGCGGCCTCGGAGCGCGGCG
GAGCCAGACGCTGACCACGTTCCTCTCCTCGGTCTCCTCCGCCTCCAGCTCCGCGCTGCCCG
GCAGCCGGGAGCCATGCGACCCCAGGGCCCCGCCGCCTCCCCGCAGCGGCTCCGCGGCCTCC
TGCTGCTCCTGCTGCTGCAGCTGCCCGCGCCGTCGAGCGCCTCTGAGATCCCCAAGGGGAAG
CAAAAGGCGCAGCTCCGGCAGAGGGAGGTGGTGGACCTGTATAATGGAATGTGCTTACAAGG
GCCAGCAGGAGTGCCTGGTCGAGACGGGAGCCCTGGGGCCAATGTTATTCCGGGTACACCTG
GGATCCCAGGTCGGGATGGATTCAAAGGAGAAAAGGGGGAATGTCTGAGGGAAAGCTTTGAG
GAGTCCTGGACACCCAACTACAAGCAGTGTTCATGGAGTTCATTGAATTATGGCATAGATCT
TGGGAAAATTGCGGAGTGTACATTTACAAAGATGCGTTCAAATAGTGCTCTAAGAGTTTTGT
TCAGTGGCTCACTTCGGCTAAAATGCAGAAATGCATGCTGTCAGCGTTGGTATTTCACATTC
AATGGAGCTGAATGTTCAGGACCTCTTCCCATTGAAGCTATAATTTATTTGGACCAAGGAAG
CCCTGAAATGAATTCAACAATTAATATTCATCGCACTTCTTCTGTGGAAGGACTTTGTGAAG
GAATTGGTGCTGGATTAGTGGATGTTGCTATCTGGGTTGGCACTTGTTCAGATTACCCAAAA
GGAGATGCTTCTACTGGATGGAATTCAGTTTCTCGCATCATTATTGAAGAACTACCAAATA
AATGCTTTAATTTTCATTTGCTACCTCTTTTTTTATTATGCCTTGGAATGGTTCACTTAAAT
GACATTTTAAATAAGTTTATGTATACATCTGAATGAAAAGCAAAGCTAAATATGTTTACAGA
CCAAAGTGTGATTTCACACTGTTTTAAATCTAGCATTATTCATTTGCTTCAATCAAAAGT
GGTTTCAATATTTTTTTAGTTGGTTAGAATACTTTCTTCATAGTCACATTCTCTCAACCTA
TAATTTGGAATATTGTTGTGGTCTTTTGTTTTTTCTCTTAGTATAGCATTTTAAAAAAATA
TAAAAGCTACCAATCTTTGTACAATTTGTAAATGTTAAGAATTTTTTTATATCTGTTAAAT
AAAAATTATTTCCAACA

FIGURE 246

></usr/seqdb2/sst/DNA/Dnaseqs.min/ss.DNA76393
><subunit 1 of 1, 243 aa, 1 stop
><MW: 26266, pI: 8.43, NX(S/T): 1
MRPQGPAASPQRLRGLLLLLLLQLPAPSSASEIPKGKQKAQLRQREVVDLYNGMCLQGPAGV
PGRDGSPGANVIPGTPGIPGRDGFKGEKGECLRESFEESWTPNYKQCSWSSLNYGIDLGKIA
ECTFTKMRSNSALRVLFSGSLRLKCRNACCQRWYFTFNGAECSGPLPIEAIIYLDQGSPEMN
STINIHRTSSVEGLCEGIGAGLVDVAIWVGTCSDYPKGDASTGWNSVSRIIIEELPK

Signal peptide:

amino acids 1-30

Transmembrane domain:

amino acids 195-217

NUCLEIC ACID ENCODING PRO 1410 POLYPEPTIDES

RELATED APPLICATIONS

This application is a continuation of, and claims priority under 35 USC §120 to, U.S. application Ser. No. 09/946,374 filed Sep. 4, 2001, which is a continuation of, and claims priority under 35 USC §120 to, PCT Application PCT/US00/04342 filed Feb. 18, 2000, which claims priority under 35 USC §119 to U.S. Provisional Application No. 60/162,506 filed Oct. 29, 1999, where PCT/US00/04342 is a continuation-in-part of, and claims priority under 35 USC §120 to, U.S. application Ser. No. 09/403,297 filed Oct. 18, 1999, now abandoned, which is the National Stage filed under 35 USC §371 of PCT Application PCT/US99/20111 filed Sep. 1, 1999, which claims priority under 35 USC §119 to U.S. Provisional Application No. 60/101,476 filed Sep. 23, 1998.

FIELD OF THE INVENTION

The present invention relates generally to the identification and isolation of novel DNA and to the recombinant production of novel polypeptides.

BACKGROUND OF THE INVENTION

Extracellular proteins play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including as pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.* 93:7108–7113 (1996); U.S. Pat. No. 5,536,637)].

Membrane-bound proteins and receptors can play important roles in, among other things, the formation, differentiation and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interactions. The membrane-bound proteins can also be employed for screening of potential peptide or small molecule inhibitors of the relevant receptor/ligand interaction.

Efforts are being undertaken by both industry and academia to identify new, native receptor or membrane-bound proteins. Many efforts are focused on the screening of mammalian recombinant DNA libraries to identify the coding sequences for novel receptor or membrane-bound proteins.

1. PRO1560

The tetraspan family of proteins has grown to include approximately 20 known genes from various species, including drosophila. The tetraspans are also known as the transmembrane 4 (TM4) superfamily and are proposed to have an organizing function in the cell membrane. Their ability to interact with other molecules and function in such diverse activities as cell adhesion, activation and differentiation, point to a role of aggregating large molecular complexes. Skubitz, et al., *J. Immunology*, 157:3617–3626 (1996). The tetraspan group has also emerged as a set of proteins with prominent functions in Schwann cell biology. Mirsky and Jessen, *Curr. Opin. Neurobiol.*, 6(1):89–96 (1996). Tetraspans (also sometimes called tetraspanins) are further described in Maecker, et al., *FASEB*, 11:428–442 (1997). Thus, members of the tetraspan family are of interest.

2. PRO444

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO444.

3. PRO1018

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1018.

4. PRO1773

The primary and rate-limiting step in retinoic acid biosynthesis requires the conversion of retinol to retinal. Retinol dehydrogenase proteins are enzymes which function to recognize holo-cellular retinol-binding protein as a substrate, thereby catalyzing the first step of retinoic acid biogenesis from its substrate. Various retinol dehydrogenase genes have been cloned and characterized, wherein the products of these genes are suggested as potentially being useful for the treatment of retinitis pigmentosa, psoriasis, acne and various cancers (Chai et al., *J. Biol. Chem.* 270:28408–28412 (1995) and Chai et al., *Gene* 169:219–222 (1996)). Given the obvious importance of the retinol dehydrogenase enzymes, there is significant interest in the identification and characterization of novel polypeptides having homology to a retinol dehydrogenase. We herein describe the identification and characterization of novel polypeptides having homology to a retinol dehydrogenase protein, designated herein as PRO1773 polypeptides.

5. PRO1477

Glycosylation is an important mechanism for modulating the physiochemical and biological properties of proteins in a stage- and tissue-specific manner. One of the important enzymes involved in glycosylation in *Saccharomyces cerevisiae* is alpha 1,2-mannosidase, an enzyme that catalyzes the conversion of Man9GlcNAc2 to Man8GlcNAc2 during the formation of N-linked oligosaccharides. The *Saccharomyces cerevisiae* alpha 1,2-mannosidase enzyme of is a member of the Class I alpha 1,2-mannosidases that are conserved from yeast to mammals. Given the important roles played by the alpha 1,2-mannosidases and the mannosidases in general in glycosylation and the physiochemical activity regulated by glycosylation, there is significant interest in identifying novel polypeptides having homology to one or more mannosidases. We herein describe the identification and characterization of novel polypeptides having homology to a mannosidase protein, designated herein as PRO1477 polypeptides.

6. PRO1478

Recently, a new subfamily of galactosyltransferase genes that encode type II transmembrane proteins was identified from a mouse genomic library (Hennet et al., (1998) *J. Biol. Chem.* 273(1):58–65). Galactosyltransferases, in general, are all of interest. Beta 1,4-galactosyltransferase is been found in two subcellular compartments where it is believed to perform two distinct function. Evans, et al., *Ioessays*, 17(3):261–268 (1995). Beta 1,4-galactosyltransferase is described as a possible transducing receptor in Dubois and Shur, *Adv. Exp. Med. Biol.*, 376:105–114 (1995), and further reported on in Shur, *Glycobiology*, 1(6):563–575 (1991). Expression and function of cell surface galactosyltransferase is reported on in Shur, *Biochim. Biophys. Acta.*, 988(3): 389–409 (1989). Moreover, the receptor function of galactosyltransferase during mammalian fertilization is described in Shur, *Adv. Exp. Biol.*, 207:79–93 (1986), and the receptor function during cellular interactions is described in Shur, *Mol. Cell Biochem.*, 61(2):143–158 (1984). Thus, it is understood that galactosyltransferases and their related proteins are of interest.

7. PRO831

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO831.

8. PRO1113

Protein-protein interactions include receptor and antigen complexes and signaling mechanisms. As more is known about the structural and functional mechanisms underlying protein-protein interactions, protein-protein interactions can be more easily manipulated to regulate the particular result of the protein-protein interaction. Thus, the underlying mechanisms of protein-protein interactions are of interest to the scientific and medical community.

All proteins containing leucine-rich repeats are thought to be involved in protein-protein interactions. Leucine-rich repeats are short sequence motifs present in a number of proteins with diverse functions and cellular locations. The crystal structure of ribonuclease inhibitor protein has revealed that leucine-rich repeats correspond to beta-alpha structural units. These units are arranged so that they form a parallel beta-sheet with one surface exposed to solvent, so that the protein acquires an unusual, nonglubular shape. These two features have been indicated as responsible for the protein-binding functions of proteins containing leucine-rich repeats. See, Kobe and Deisenhofer, *Trends Biochem. Sci.*, 19(10):415–421 (October 1994).

A study has been reported on leucine-rich proteoglycans which serve as tissue organizers, orienting and ordering collagen fibrils during ontogeny and are involved in pathological processes such as wound healing, tissue repair, and tumor stroma formation. Iozzo, R. V., *Crit. Rev. Biochem. Mol. Biol.*, 32(2):141–174 (1997). Others studies implicating leucine rich proteins in wound healing and tissue repair are De La Salle, C., et al., *Vouv. Rev. Fr. Hematol. (Germany)*, 37(4):215–222 (1995), reporting mutations in the leucine rich motif in a complex associated with the bleeding disorder Bernard-Soulier syndrome, Chlemetson, K. J., *Thromb. Haemost.* (Germany), 74(1):111–116 (July 1995), reporting that platelets have leucine rich repeats and Ruoslahti, E. I., et al., WO9110727-A by La Jolla Cancer Research Foundation reporting that decorin binding to transforming growth factors has involvement in a treatment for cancer, wound healing and scarring. Related by function to this group of proteins is the insulin like growth factor (IGF), in that it is useful in wound-healing and associated therapies concerned with re-growth of tissue, such as connective tissue, skin and bone; in promoting body growth in humans and animals; and in stimulating other growth-related processes. The acid labile subunit of IGF (ALS) is also of interest in that it increases the half-life of IGF and is part of the IGF complex in vivo.

Another protein which has been reported to have leucine-rich repeats is the SLIT protein which has been reported to be useful in treating neuro-degenerative diseases such as Alzheimer's disease, nerve damage such as in Parkinson's disease, and for diagnosis of cancer, see, Artavanistsakonas, S. and Rothberg, J. M., WO9210518-A1 by Yale University. Of particular interest is LIG-1, a membrane glycoprotein that is expressed specifically in glial cells in the mouse brain, and has leucine rich repeats and immunoglobulin-like domains. Suzuki, et al., *J. Biol. Chem.* (U.S.), 271(37): 22522 (1996). Other studies reporting on the biological functions of proteins having leucine rich repeats include: Tayar, N., et al., *Mol. Cell Endocrinol.*, (Ireland), 125(1–2): 65–70 (December 1996) (gonadotropin receptor involvement); Miura, Y., et al., *Nippon Rinsho* (Japan), 54(7):1784–1789 (July 1996) (apoptosis involvement); Harris, P. C., et al., *J. Am. Soc. Nephrol.*, 6(4):1125–1133 (October 1995) (kidney disease involvement).

9. PRO1194

The nuclear genes PET117 and PET119 are required for the assembly of active cytochrome c oxidase in *S. Cerevisiae*, and therefore, are of interest. Also of interest are nucleic acids which have sequence identity with these genes. PET genes are further described in McEwen, et al., *Curr. Genet.*, 23(1):9–14 (1993).

10. PRO1110

The bone marrow plays many important roles in the mammal. One of those roles is to provide a source of various progenitor cells that differentiate into important cells and other components of the blood and immune systems. As such, the function of the myeloid system is of extreme interest.

We herein describe the identification and characterization of novel polypeptides having homology to myeloid upregulated protein, designated herein as PRO1110 polypeptides.

11. PRO1378

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1378.

12. PRO1481

Efforts are being undertaken by both industry and academia to identify new, native proteins. Many efforts are focused on the screening of mammalian recombinant DNA libraries to identify the coding sequences for novel proteins. We herein describe the identification and characterization of a novel protein designated herein as PRO1481.

13. PRO1189

There has been much interest in the identification of receptor proteins on stem cells and progenitor cells which may be involved in triggering proliferation or differentiation. A type II transmembrane protein was identified in proliferating progenitor cells in the outer perichondrial rim of the postnatal mandibular condyle proliferation. The investigators concluded that E25 could be a useful marker for chondro-osteogenic differentiation (Deleersnijder, et al. *J. Biol. Chem.* 271(32):19475–19482 (1996)).

14. PRO1415

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1415.

15. PRO1411

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1411.

16. PRO1295

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1295.

17. PRO1359

Enzymes such as hyaluronidase, sialyltransferase, urokinase-type plasminogen activator, plasmin, matrix metalloproteinases, and others, play central roles in the catabolism of extracellular matrix molecules. As such, these enzymes and inhibitors thereof, may play roles in metastatic cancer and the treatment thereof. Van Aswegen and du Plessis, *Med. Hypotheses,* 48(5):443–447 (1997). For the foregoing reason, as well as their diversity in substrate specificity example, sialyltransferases are of particular interest. For example, a peptide of interest is the GalNAc alpha 2, 6-sailytransferase as described in Kurosawa, et al., *J. Biol. Chem.,* 269(2):1402–1409 (1994). This peptide was constructed to be secreted, and retained its catalytic activity. The expressed enzyme exhibited activity toward asialomucin and asialofetuin, but not other glycoproteins tested. As sialylation is an important function, sialyltransferases such as this one, and peptides related by sequence identity, are of interest. Sialyltransferases are further described in the literature, see for example, Sjoberg, et al, *J. Biol. Chem.,* 271(13):7450–7459 (1996), Tsuji, *J. Biochem.,* 120(1):1–13 (1996) and Harduin-Lepers, et al., *Glycobiology,* 5(8): 741–758 (1995).

18. PRO1190

Kang et al. reported the identification a novel cell surface glycoprotein of the Ig superfamily (*J. Cell biol.* (1997) 138(1):203–213). Cell adhesion molecules of the Ig superfamily are implicated in a wide variety of biological processes, including cell migration, growth control, and tumorigenesis. The Kang et al. studies suggest that loss of CDO function may play a role in oncogenesis. Accordingly, the identification of additional CDO-like molecules, and more generally, cell adhesion molecules of the Ig superfamily, is of interest.

19. PRO1772

Peptidases are enzymatic proteins that function to cleave peptide substrates either in a specific or non-specific manner. Peptidases are generally involved in a large number of very important biological processes in mammalian and non-mammalian organisms. Numerous different peptidase enzymes from a variety of different mammalian and non-mammalian organisms have been both identified and characterized. The mammalian peptidase enzymes play important roles in many different biological processes including, for example, protein digestion, activation, inactivation, or modulation of peptide hormone activity, and alteration of the physical properties of proteins and enzymes.

In light of the important physiological roles played by peptidase enzymes, efforts are currently being undertaken by both industry and academia to identify new, native peptidase homologs. Many of these efforts are focused on the screening of mammalian recombinant DNA libraries to identify the coding sequences for novel transmembrane proteins. Examples of screening methods and techniques are described in the literature [see, for example, Klein et al., *Proc. Natl. Acad. Sci.,* 93:7108–7113 (1996); U.S. Pat. No. 5,536,637)]. We herein describe the identification of novel polypeptides having homology to various peptidase enzymes, designated herein as PRO1772 polypeptides.

20. PRO1248

Putative protein-2 (PUT-2) is a homolog of the human disease genes L1CAM, G6PD and P55 (Riboldi Tunnicliffe et al., *Genome Analysis,* submitted). As such, there is interest in identifying novel polypeptides and encoding DNA having homology to the PUT-2 protein. We herein describe the identification and characterization of novel polypeptides having homology to PUT-2 protein, designated herein as PRO1248 polypeptides.

21. PRO1316

Dickkopf (Dkk) is a family of secreted proteins having a high degree of homology in the cysteine-rich domains (i.e., 80–90%). Dkk-1, the first discovered member, of this family has potent head-inducgin activity on the Spemann organizer. Glinka et al., Nature 391 (6665): 357–362 (1988). The Spemann organizer of the amphibian embryo can be subdivided into two discrete activities, namely trunk organizer and head organizer. Dkk-1 has been found to be both sufficient and necessary to cause head induction in Xenopus embryos and is further a potent antagonist of Wnt signaling, suggesting that the Dkk genes encode an entire family of Wnt inhibitors.

Members of the Wnt gene family function in both normal development and differentiation as well as in tumorigenesis. Wnts are encoded by a large gene family whose members have been found in round worms, insects, cartilaginous fish, and vertebrates. Holland et al., Dev. Suppl., 125–133 (1994). Wnt genes encode a family of secreted glycoproteins that modulate cell fate and behavior in embryos through activation of receptor-mediated signaling pathways.

Studies of mutations in Wnt genes have indicated a role for Wnts in growth control and tissue patterning. In Drosophila, wingless (wg) encodes a Wnt-related gene (Rijsewik et al., Cell, 50: 649–657 (1987)) and wg mutations alter the pattern of embryonic ectoderm, neurogenesis, and imaginal disc outgrowth. Morata and Lawrence, Dev. Biol., 56: 227–240 (1977); Baker, Dev. Biol., 125: 96–108 (1988); Klingensmith and Nusse, Dev. Biol., 166: 396–414 (1994). In *Caenorhabditis elegans*, lin-44 encodes a Wnt homolog which is required for asymmetric cell divisions. Herman and Horvitz, Development, 120: 1035–1047 (1994). Knock-out mutations in mice have shown Wnts to be essential for brain development (McMahon and Bradley, Cell, 62: 1073–1085 (1990); Thomas and Cappechi, Nature, 346: 847–850 (1990)), and the outgrowth of embryonic primordia for kidney (Stark et al., Nature, 372: 679–683 (1994)), tail bud (Takada et al., Genes Dev., 8: 174–189 (1994)), and limb bud. Parr and McMahon, Nature, 374: 350–353 (1995). Overexpression of Wnts in the mammary gland can result in mammary hyperplasia and tumors, ((McMahon, supra (1992); Nusse and Varnius, H. E., Cell 69: 1073–1087 (1992)), and precocious alveolar development. Bradbury et al., Dev. Biol., 170: 553–563 (1995). Moreover, constitutive expression of Wnt-4 in virgin hosts of transplanted mammary epithelium resulted in highly branched tissue, similar to a pregnancy-like growth pattern. Bradbury et al., Dev. Biol. 170: 553–563 (1995).

The Wnt/Wg signal transduction pathway plays an important role in the biological development of the organism and has been implicated in several human cancers. This pathway also includes the tumor suppressor gene, APC. Mutations in the APC gene are associated with the development of sporadic and inherited forms of human colorectal cancer. For example, elevated levels of Wnt-2 have been observed in colorectal cancers. Vider, B-Z. et al., Oncogene 12: 153–158 (1996).

22. PRO1197

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1197.

23. PRO1293

Immunoglobulins are antibody molecules, the proteins that function both as receptors for antigen on the B-cell membrane and as the secreted products of the plasma cell. Like all antibody molecules, immunoglobulins perform two major functions: they bind specifically to an antigen and they participate in a limited number of biological effector functions. Therefore, new members of the Ig superfamily and fragments thereof are always of interest. Molecules which act as receptors by various viruses and those which act to regulate immune function are of particular interest. Also of particular interest are those molecules which have homology to known Ig family members which act as virus receptors or regulate immune function. Thus, molecules having homology to Ig superfamily members and fragments thereof (i.e., heavy and light chain fragments) are of particular interest.

We herein describe the identification and characterization of novel polypeptides having homology to an immunoglobulin heavy chain variable region protein, designated herein as PRO1293 polypeptides.

24. PRO1380

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1380.

25. PRO1265

The identification of novel secreted proteins involved in physiological and metabolic pathways is of interest because of their potential use as pharmaceutical agents. Of particular interest is the identification of novel polypeptides that are potentially involved in immune response and inflammation mechanisms. A novel polypeptide has recently been identified that is expressed in mouse B cells in response to IL-4. The gene encoding this polypeptide is referred to as interleukin-four induced gene 1, or "FIG. 1" (Chu et al. *Proc. Natl. Acad. Sci* (1997) 94(6):2507–2512).

26. PRO1250

Long chain fatty acid CoA ligase is an enzymatic protein that functions to ligate together long chain fatty acids, a function that plays important roles in a variety of different physiological processes. Given the importance of this enzymatic protein, efforts are currently being undertaken to identify novel long chain fatty acid CoA ligase homologs. We herein describe the identification and characterization of novel polypeptides having homology to long chain fatty acid CoA ligase, designated herein as PRO1250 polypeptides.

27. PRO1475

N-acetylglucosaminyltransferase proteins comprise a family of enzymes that provide for a variety of important biological functions in the mammalian organism. As an example, UDP-N-acetylglucosamine: alpha-3-D-mannoside beat-1,2-N-acetylglucosaminyltransferase I is an enzymatic protein that catalyzes an essential first step in the conversion of high-mannose N-glycans to hybrid and complex N-glycans (Sarkar et al., *Proc. Natl. Acad. Sci. USA*. 88:234–238 (1991). Given the obvious importance of the N-acetylglucosaminyltransferase enzymes, there is significant interest in the identification and characterization of novel polypeptides having homology to an N-acetylglucosaminyltransferase protein. We herein describe the identification and characterization of novel polypeptides having homology to an N-acetylglucosaminyltransferase protein, designated herein as PRO1475 polypeptides.

28. PRO1377

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1377.

29. PRO1326

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1326.

30. PRO1249

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1249.

31. PRO1315

Many important cytokine proteins have been identified and characterized and shown to signal through specific cell surface receptor complexes. For example, the class II cytokine receptor family (CRF2) includes the interferon receptors, the interleukin-10 receptor and the tissue factor CRFB4 (Spencer et al., *J. Exp. Med.* 187:571–578 (1998) and Kotenko et al., *EMBO J.* 16:5894–5903 (1997)). Thus, the multitude of biological activities exhibited by the various cytokine proteins is absolutely dependent upon the presence of cytokine receptor proteins on the surface of target cells. There is, therefore, a significant interest in identifying and characterizing novel polypeptides having homology to one or more of the cytokine receptor family. We herein describe the identification and characterization of a novel polypeptide having homology to cytokine receptor family-4 proteins, designated herein as PRO1315 polypeptides.

32. PRO1599

Granzyme M is a natural killer cell serine protease. The human gene is 7.5 kilobases, has an exon-intron structure identical to other serine proteases, and is closely linked to the serine protease gene cluster on chromosome 19p13.3. (Pilat et al., *Genomics,* 24:445–450 (1994)). Granzyme M has been found in two human natural killer leukemia cell lines, unstimulated human peripheral blood monocytes and untreated purified CD3-CD56+ large granular lymphocytes. (Smyth et al., *J. Immunol.,* 151:6195–6205 (1993)).

33. PRO1430

Reductases form a large class of enzymatic proteins found in a variety of mammalian tissues and play many important roles for the proper functioning of these tissues. They are antioxidant enzymes that catalyze the conversion of reactive oxygen species to water. Abnormal levels or functioning of reductases have been implicated in several diseases and disorders including strokes, heart attacks, oxidative stress, hypertension and the development of both benign and malignant tumors. For example, malignant prostate epithelium may have lowered expression of such antioxidant enzymes [Baker et al., *Prostate* 32(4):229–233 (1997)]. International patent application no. WO9622360-A1 describes a prostate specific reductase that is useful for diagnosing and treating prostate cancer and screening new antagonists. Inhibitors of alpha-reductase have been used in the treatment of benign prostatic hyperplasia (Anderson, *Drugs Aging* (1996) 6(5): 388–396). For these reasons, the identification of new members of the reductase family has been of interest for the treatment and diagnosis of cancers and other diseases and disorders.

34. PRO1374

Prolyl 4-hyroxylase (P4HA) catalyzes the formation of 4-hydroxyproline in collagens. Annunen, et al., J. Biol. Chem., 272(28):17342–17348 (1997); Helaakoski, et al., PNAS USA, 92(10):4427–4431 (1995); and Hopkinson, et al., Gene, 149(2):391–392 (1994). This enzyme and molecules related thereto are of interest.

35. PRO1311

The tetraspan family of proteins, also referred to as the "transmembrane 4 (TM4) superfamily", are proposed to have an organizing function in the cell membrane. It is believed that they interact with large molecular complexes and function in such diverse activities as cell adhesion, activation and differentiation (see Maecker et al. *FASEB* (1997) 11:428–442). Accordingly, the identification of new members of the tetraspan family of proteins is of interest. Efforts are being undertaken by both industry and academia to identify new, native transmembrane proteins. Many efforts are focused on the screening of mammalian recombinant DNA libraries to identify the coding sequences for novel receptor proteins.

36. PRO1357

Ebnerin is a cell surface protein associated with von Ebner glands in mammals. Efforts are being undertaken by both industry and academia to identify new, native proteins and specifically those which possess sequence homology to cell surface proteins such as ebnerin or other salivary gland-associated proteins. Many of these efforts are focused on the screening of mammalian recombinant DNA libraries to identify the coding sequences for novel receptor proteins. We herein describe the identification of novel polypeptides having significant homology to the von Ebner minor salivary gland-associated protein, designated herein as PRO1357 polypeptides.

37. PRO1244

One type of transmembrane protein that has received attention is implantation-associated uterine protein. Deficiencies or abnormalities of this protein may be a cause of miscarriage. Therefore, the identification and characterization of implantation-associated proteins is of interest.

38. PRO1246

Bone-related sulphatase is an enzymatic protein that has been shown to degrade sulphate groups of proteoglycan sugar chains in bone tissue (Australian Patent Publication No. AU 93/44921-A, Mar. 3, 1994). Because of its specific sulphatase activity, it has been suggested that bone-related sulphatase may find use in the treatment of bone metabolic diseases. As such, there is significant interest in identifying and characterizing novel polypeptides having sequence similarity to bone-related sulphatase. We herein describe the identification and characterization of novel polypeptides having homology to bone-related sulphatase, designated herein as PRO1246 polypeptides.

39. PRO1356

*Clostridium perfringens* enterotoxin (CPE) is considered to be the virulence factor responsible for causing the symptoms of *C. perfringens* type A food poisoning and may also be involved in other human and veterinary illnesses (McClane, *Toxicon.* 34:1335–1343 (1996)). CPE carries out its adverse cellular functions by binding to an approximately 50 kD cell surface receptor protein designated the *Clostridium perfringens* enterotoxin receptor (CPE-R) to form an approximately 90,000 kD complex on the surface of the cell. cDNAs encoding the CPE-R protein have been identified characterized in both human and mouse (Katahira et al.,*J. Cell Biol.* 136:1239–1247 (1997) and Katahira et al., *J. Biol. Chem.* 272:26652–26658 (1997)). Since the CPE toxin has been reported to cause a variety of illnesses in mammalian hosts and those illnesses are initiated by binding of the CPE toxin to the CPE-R, there is significant interest in identifying novel CPE-R homologs. We herein describe the identification and characterization of novel polypeptides having homology to the CPE-R, designated herein as PRO1356 polypeptides.

40. PRO1275

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1275.

41. PRO1274

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1274.

42. PRO1412

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1412.

43. PRO1557

The identification of secretory proteins that play roles in neural development are of interest. Such proteins may find use in the understanding of and possible treatment of neurological diseases and disorders. Chordin protein, which has been isolated from Xenopus, is a potent dorsalizing factor that regulates cell-cell interactions in the organizing centers of Xenopus head, trunk and tail development (Sasai et al., (1994) *Cell* 79(5):779–790; see also Mullins, (1998) *Trends Genet.* 14(4):127–129; and Kessel et al. (1998)) *Trends Genet.* 14(5):169–171). It may be used as a component of culture medium for culturing nerve and muscle cells, and may have use in the treatment of neurodegenerative diseases and neural injury (U.S. Pat. No. 5,679,783).

44. PRO1286

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1286.

45. PRO1294

The extracellular mucous matrix of olfactory neuroepithelium is a highly organized structure in intimate contact with chemosensory cilia that house the olfactory transduction machinery. The major protein component of this extracellular matrix is olfactomedin, a glycoprotein that is expressed in olfactory neuroepithelium and which form intermolecular disulfide bonds so as to produce a polymer (Yokoe et al., *Proc. Natl. Acad. Sci. USA* 90:4655–4659 (1993), Bal et al., *Biochemistry* 32:1047–1053 (1993) and Snyder et al., *Biochemistry* 30:9143–9153 (1991)). It has been suggested that olfactomedin may influence the maintenance, growth or differentiation of chemosensory cilia on the apical dendrites of olfactory neurons. Given this important role, there is significant interest in identifying and characterizing novel polypeptides having homology to olfactomedin. We herein describe the identification and characterization of a novel polypeptide having homology to olfactomedin protein.

We herein describe the identification and characterization of novel polypeptides having homology to olfactomedin protein, designated herein as PRO1294 polypeptides.

46. PRO1347

Butyrophilin is a milk glycoprotein that constitutes more than 40% of the total protein associated with the fat globule membrane in mammalian milk. Expression of butyrophilin mRNA has been shown to correlate with the onset of milk fat production toward the end pregnancy and is maintained throughout lactation. Butyrophilin has been identified in bovine, murine and human (see Taylor et al., *Biochim. Biophys. Acta* 1306:1–4 (1996), Ishii et al., *Biochim. Biophys. Acta* 1245:285–292 (1995), Mather et al., *J. Dairy Sci.* 76:3832–3850 (1993), Ogg, et al., *Mamm. Genome,* 7(12): 900–905 (1996), Sato, et al., *J. Biochem.,* 117(1):147–157 (1995) and Banghart et al., *J. Biol. Chem.* 273:4171–4179 (1998)) and is a type I transmembrance protein that is incorporated into the fat globulin membrane. It has been suggested that butyrophilin may play a role as the principle scaffold for the assembly of a complex with xanthine dehydrogenase/oxidase and other proteins that function in the budding and release of milk-fat globules from the apical surface during lactation (Banghart et al., supra). Given that butyrophilin plays a role in mammalian milk production, there is substantial interest in identifying novel butyrophilin homologs.

47. PRO1305

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1305.

48. PRO1273

The lipocalin protein family is a large group of small extracellular proteins. The family demonstrates great diversity at the sequence level; however, most lipocalins share characteristic conserved sequence motifs. Lipocalins are known to be involved in retinol transport, invertebrate cryptic coloration, olfaction and pheromone transport, and prostaglandin synthesis. The lipocalins have also been implicated in the regulation of cell homoeostasis and the modulation of the immune response, and as carrier proteins, to act in the general clearance of endogenous and exogenous compounds. Flower, *Biochem. J.,* 318(Pt 1):1–14 (1996); Flower, *FEBS Lett.,* 354(1):7–11 (1994). Thus, novel members of the lipocalin protein family are of interest.

49. PRO1302

CD33 is a cell-surface protein that is a member of the sialoadhesin family of proteins that are capable of mediating sialic-acid dependent binding with distinct specificities for both the type of sialic acid and its linkage to subterminal sugars. CD33 is specifically expressed in early myeloid and some monocyte cell lineages and has been shown to be strongly associated with various myeloid tumors including, for example, acute non-lymphocytic leukemia (ANLL). As such, CD33 has been suggested as a potential target for the treatment of cancers associated with high level expression of the protein. One CD33 homolog (designated CD33L) is described in Takei et al., *Cytogenet. Cell Genet.* 78:295–300 (1997). Another study describes the use of CD33 monoclonal antibodies in bone marrow transplantation for acute myeloid leukemia. Robertson, et al., *Prog. Clin. Biol. Res.,* 389:47–63 (1994).

Moreover, studies have reported that members of the sialoadhesion family contribute to a range of macrophage functions, both under normal conditions as well as during inflammatory reactions. Crocker, et al., *Glycoconj. J.,* 14(5): 601–609 (1997). Moreover, these proteins are associated with diverse biological processes, i.e., hemopoiesis, neuronal development and immunity. Kelm, et al., *Glycoconj. J.*, 13(6):913–926 (1996). Thus, novel polypeptides related to CD33 by sequence identity are of interest.

50. PRO1283

Olfactory reception occurs via the interaction of odorants with the chemosensory cilia of the olfactory receptor cells located in the nasal epithelium. Based upon the diversity of nasal epithelial-associated odorant binding proteins, the mammalian olfactory system is capable of recognizing and discriminating a large number of different odorant molecules. In this regard, numerous different odorant binding proteins and their encoding DNA have recently been identified and characterized (Dear et al., *Biochemistry* 30: 10376–10382 (1991), Peysner et al., *Science* 241:336–339 (1988), Bucket al., *Cell* 65:175–187 (1991) and Breer et al., *J. Recent. Res.* 12:527–540 (1993)). Because study of the mechanisms of odorant detection by the mammalian olfactory system are of interest, there is significant interest in identifying novel odorant binding protein. We herein describe the identification and characterization of novel polypeptides having homology to odorant binding proteins, designated herein as PRO1283 polypeptides.

51. PRO1279

Proteases are enzymatic proteins which are involved in a large number of very important biological processes in mammalian and non-mammalian organisms. Numerous different protease enzymes from a variety of different mammalian and non-mammalian organisms have been both identified and characterized, including the serine proteases which exhibit specific activity toward various serine-containing proteins. The mammalian protease enzymes play important roles in biological processes such as, for example, protein digestion, activation, inactivation, or modulation of peptide hormone activity, and alteration of the physical properties of proteins and enzymes.

Neuropsin is a novel serine protease whose mRNA is expressed in the central nervous system. Mouse neuropsin has been cloned, and studies have shown that it is involved in the hippocampal plasticity. Neuropsin has also been indicated as associated with extracellular matrix modifications and cell migrations. See, generally, Chen, et al., *J. Neurosci.*, 7(2):5088–5097 (1995) and Chen, et al., *J. Histochem. Cytochem.*, 46:313–320 (1998).

We herein describe the identification and characterization of novel polypeptides having homology to neuropsin protein, designated herein as PRO1279 polypeptides.

52. PRO1304

The immunophilins are a family of proteins that function as receptors for immunosuppressant drugs, such as cyclosporin A, FK506, and rapamycin. The immunophilins occur in two separate classes, (1) the FK506-binding proteins (FKBPs), which bind to FK506 and rapamycin, and (2) the cyclophilins, which bind to cyclosporin A. With regard to the FK506-binding proteins, it has been reported that the FK506/FKBP complex functions to inhibit the activity of the serine/threonine protein phosphatase 2B (calcineurin), thereby providing immunosuppressant activity (Gold, *Mol. Neurobiol.* 15:285–306 (1997)). It has also been reported that the FKBP immunophilins are found in the mammalian nervous system and may be involved in axonal regeneration in the central nervous system through a mechanism that is independent of the process by which immunosuppression is achieved (Gold, supra). Thus, there is substantial interest in identifying novel polypeptides having homology to the FKBP immunophilins.

We herein describe the identification and characterization of novel polypeptides having homology to FK506 binding protein, designated herein as PRO1304 polypeptides.

53. PRO1317

There is considerable interest in the identification of molecules whose expression is increased upon stimulation of leukocyte populations because insights into the structure and function of these molecules may lead to further understanding of the intracellular and intercellular events that accompany activation. One such molecule, CD97, a cell surface antigen that is rapidly upregulated upon activation on lymphocytes, has recently been the subject of several publications (see Eichler et al. in *Tissue Antigens* (1997) 50(5):429–438; Aust et al., *Cancer Res.* (1997) 57(9): 1798–1806). Leukocytes strongly positive for CD97 are concentrated at sites of inflammation relative to CD97 expression in normal lymphoid tissue. A soluble subunit of CD97, CD97alpha, has been found in the body fluids from inflamed tissues (Gray et al. *J. Immunol.* (1996) 157(12): 5438–5447).

54. PRO1303

Proteases are enzymatic proteins which are involved in a large number of very important biological processes in mammalian and non-mammalian organisms. Numerous different protease enzymes from a variety of different mammalian and non-mammalian organisms have been both identified and characterized, including the serine proteases which exhibit specific activity toward various serine-containing proteins. The mammalian protease enzymes play important roles in biological processes such as, for example, protein digestion, activation, inactivation, or modulation of peptide hormone activity, and alteration of the physical properties of proteins and enzymes.

Neuropsin is a novel serine protease whose mRNA is expressed in the central nervous system. Mouse neuropsin has been cloned, and studies have shown that it is involved in the hippocampal plasticity. Neuropsin has also been indicated as associated with extracellular matrix modifications and cell migrations. See, generally, Chen, et al., *J. Neurosci.*, 7(2):5088–5097 (1995) and Chen, et al., *J. Histochem. Cytochem.*, 46:313–320 (1998). Other studies have reported that kindling induces neuropsin mRNA in the mouse brain. Okabe, et al., *Brain Res.*, 728(1):116–120 (1996). Additionally, a study has reported that generation of reactive oxygen species has an important role in neuropsin transcript in the limbic areas which might be related to the disturbance in avoidance learning. Akita, et al., *Brain Res.*, 769(1):86–96 (1997). Thus, neuropsins, and related proteins and agents, including agonists and antagonists are of interest.

55. PRO1306

There is much interest in the identification of proteins that play roles in mammalian disease and disorders which could lead to new methods of treatment. A macrophage polypeptide, daintain/allograft inflammatory factor 1 (daintain/AIF1), has been identified in the pancreas of prediabetic rats, and has been determined to have a direct effect on insulin secretion. When injected intravenously in mice in low doses, daintain/AIF1 doses inhibited glucose-stimulated insulin secretion with a concomitant impairment of glucose elimination. At higher doses, daintain/AIF1 potentiated glucose-stimulated insulin secretion and enhanced glucose elimination. Thus, it was suggested that daintain/AIF1 may have a role in connection with the pathogenesis of insulin-dependent diabetes mellitus (Chen et al. *Proc. Natl Acad. Sci.* (1997) 94(25):13879–13884). AIF-1 has also been implicated in both rat and human allogenic heart transplant rejection (Utans et al. *Transplantation* (1996) 61(9):1387–1392), and may play a role in macrophage activation and function (Utans et al. *J. Clin. Invest.* (1995) 95(6):2954–2962).

56. PRO1336

Protein-protein interactions include receptor and antigen complexes and signaling mechanisms. As more is known about the structural and functional mechanisms underlying protein-protein interactions, protein-protein interactions can be more easily manipulated to regulate the particular result of the protein-protein interaction. Thus, the underlying mechanisms of protein-protein interactions are of interest to the scientific and medical community.

Leucine-rich proteins are known to be involved in protein-protein interactions. A study has been reported on leucine-rich proteoglycans which serve as tissue organizers, orienting and ordering collagen fibrils during ontogeny and are involved in pathological processes such as wound healing, tissue repair, and tumor stroma formation. Iozzo, R. V., *Crit. Rev. Biochem. Mol. Biol.*, 32(2):141–174 (1997). Others studies implicating leucine rich proteins in wound healing and tissue repair are De La Salle, C., et al., *Vouv. Rev. Fr. Hematol.* (Germany), 37(4):215–222 (1995), reporting mutations in the leucine rich motif in a complex associated with the bleeding disorder Bernard-Soulier syndrome and Chlemetson, K. J., *Thromb. Haemost.* (Germany), 74(1): 111–116 (July 1995), reporting that platelets have leucine rich repeats.

Another protein of particular interest which has been reported to have leucine-rich repeats is the slit protein which has been reported to be useful in treating neuro-degenerative diseases such as Alzheimer's disease, nerve damage such as in Parkinson's disease, and for diagnosis of cancer, see, Artavanistsakonas, S. and Rothberg, J. M., WO9210518-A1 by Yale University. The slit protein has been characterized and reported to be secreted by glial cells and involved in the formation of axonal pathways in Drosophila as well as the mediation of extracellular protein interactions. Wharton and Crews, *Mech. Dev.*, 40(3):141–15491993); Rothberg and Artavanis-Tsakonas, *J. Mol. Biol.*, 227(2):367–370 (1992); Rothberg, et al., *Genes Dev.*, 4(12A):2169–2197 (1990); and Rothberg, et al., *Cell*, 55(6):1047–1059 (1988).

57. PRO1278

Lysozymes are secreted enzymes that preferentially hydrolyze the [beta]-1,4 glucosidic linkages between N-acetylmuramic acid and N-acetylgucosamine which occur in the mucopeptide cell wall structure of certain microorganisms. Lysozyme is of widespread distribution in animals and plants. It has been found in mammalian secretions and tissues including saliva, tears, milk, cervical mucus, leucocytes, kidneys, etc. The identification of new members of the lysozyme family of proteins is of interest because of the variety of roles lysozymes play in metabolic function and dysfunction. Abnormal levels of lysozymes have been implicated in various disease states. Lysozymes have been reported to have anti-microbial, analgesic, and antinociceptive properties. Additional characteristics and possible uses of lysozymes are described in U.S. Pat. No. 5,618,712.

58. PRO1298

Glycosylation can determine the fate of a protein, for example, whether it is secreted or not. Also, glycoproteins play many structural and functional roles, particularly as part of the cell membrane. Therefore, glycosylation is of interest. Studies have reported on the growth-related coordinate regulation of the early N-glycosylation genes in yeast. Kukuruzinska and Lennon, *Glycobiology*, 4(4):437–443 (1994). Moreover, the relationship between protein glycosylation and fatty acylation of glycoproteins was studied in the wild-type and asparagine-linked glycosylation-deficient mutants in yeast. Appukuttan, *FEBS Lett.*, 255(1):139–142 (1989). The biosynthesis of asparagine-linked oligosaccharides in yeast was also studied using a mutant. Jackson, et al., *Glycobiology*, 3(4):357–364 (1993). Yeast mutants deficient in protein glycosylation have also been reported in Huffacker and Robbins, *PNAS*, 80(24):7466–7470 (1983).

59. PRO1301

Cytochrome P450 proteins form a large class of monooxygenase enzymes involved in hydroxylation. Hydroxylation reactions are important in the synthesis of cholesterol and steroid hormones. Enzymes of the cytochrome P450 family play an important role in the metabolism endogenous compounds such as arachidonic acid. These enzymes are also important in the metabolism of foreign substances such as the elimination of drugs from the body [see, for example, Peterson, *Aliment. Pharmacol. Ther.*, 9:1–9 (1995).]. In addition, metabolites generated through the cytochrome P450 pathway may play a role in carcinogenesis, blood pressure regulation and renal function [see, for example, Rahman et al., *Am. J. Hypertens.*, 10:356–365 (1997)].

60. PRO1268

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1268.

61. PRO1269

Granulocytes, the most common type of white blood cell, have the ability to mediate immunologic cytotoxicity against tumor cells and microorganisms. Accordingly, there has been interest in identifying various factors that are produced by these cells because of their potential use as pharmaceutical agents. Patent publication no. WO9729765-A1, to Selsted, describes the identification of granulocyte peptide A which was isolated from bovine and murine granulocytes. Several uses for this peptide were identified including, a therapeutic use, use as an agricultural agent, use as a preservative for food, and use as a water treatment agent.

62. PRO1327

Neurexophilin is a protein that was discovered as a neuronal glycoprotein that was copurified with neurexin I alpha during affinity chromatography on immobilized alpha-latrotoxin (Missler et al., *J. Neurosci.* 18:3630–3638 (1998)). Recent data has shown that the mammalian brain contains four genes for neurexophilins the products of which share a common structure composed of five domains: (1) an N-terminal signal peptide, (2) a variable N-terminal domain, (3) a highly conserved central domain that is N-glycosylated, (4) a short linker region and (5) a conserved C-terminal domain that is cysteine-rich (Missler et al., supra). These data further demonstrate that the neurexophilins are proteolytically processed after synthesis and bind to alpha-neurexins. The structure and characteristics of neurexophilins indicate that they may function as neuropeptides that may signal via alpha-neurexins. Therefore, there is significant interest in identifying and characterizing novel polypeptides having homology to the neurexophilins.

We herein describe the identification and characterization of novel polypeptides having homology to neurexophilin protein, designated herein as PRO1327 polypeptides.

63. PRO1382

Cerebellin is a secreted, postsynaptic neuroprotein found throughout the brain. The highest concentrations of this protein have been found in the cerebellum. It has also been detected in the pituitary, spinal cord, and adrenal glands (Satoh et al. *J. Endocrinol.* (1997) 15491):27–34). The feasibility of using cerebellum as a quantifiable marker for the investigation of the maturation of Purkinje cells of the cerebellum and to chart neurodevelopment has been reported (see Slemmon et al. *Proc. Natl. Acad. Sci* (1985) 82(20):7145–7148). Significantly decreased levels of cerebellin have been found in human brains obtained in postmortem studies from patients with spinocerebellar degeneration, olivopontocerebellar atrophy (OPCAQ) and Shy-Drager syndrome, suggesting that cerebellin plays important pathophysiological roles in these cerebellar diseases (Mizuno et al. *Brain Res.* (1995) 686(1):115–118; Mizuno et al. *No To Shinkei* (1995) 47(11):1069–1074). In view of the importance of cerebellin in neurodevelopment and in neurological diseases and disorders, the identification and characterization of members of this protein family is of interest (see also Yiangou et al. *J. Neurochem* (1989) 53(3): 886–889 and Mugnaini et al. *Synapse* (1988) 2(2):125–138).

64. PRO1328

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1328.

65. PRO1325

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1325.

66. PRO1340

Cadherins are known as the principal mediators of homotypic cellular recognition and play a demonstrated role in the morphogenic direction of tissue development. Cadherins are a diverse family of proteins that have been identified in various tissues including nervous tissue (Suzuki et al., *Cell Regul.*, 2:261–270 (1991)). Ksp-cadherin is a kidney-specific member of the cadherin multigene family (Thomson et al., *Biol. Chem*, 270:17594–17601 (1995)). Cadherins are thought to play an important role in human cancer (Yap, *Cancer Invest.*, 16:252–261 (1998)).

67. PRO1339

Carboxypeptidases are of interest. Carboxypeptidase E appears to be involved in the biosynthesis of a wide range of peptide hormones. Fricker, *Annu. Rev. Physiol.*, 50:309–321 (1988). This carboxypeptidase has been associated with obesity. Leiter, *J. Endocrinol.*, 155(2):211–214 (1997). Carboxypeptidase M has been reported as being a marker of macrophage maturation. Krause, et al., *Immunol. Rev.*, 161:119–127 (1998). Human mast cell carboxypeptidase has been reported to be associated with allergies. Goldstein, et al., *Monogr. Allergy*, 27:132–145 (1990). Carboxypeptidase A2 has also been reported on. Faming, et al., *J. Biol. Chem.*, 266(36):24606–24612 (1991). Other carboxypeptidases of particular interest which are known in the art include human pancreatic carboxypeptidase 2, carboxypeptidase al and carboxypeptidase B. Therefore, novel members of the carboxypeptidase family are of interest.

68. PRO1337

Of particular interest is the identification of blood-related proteins which may have potential therapeutic use or may be useful in the diagnosis of blood-related disorders. Thyroxine-binding globulin (TBG) is synthesized by the liver and secreted into the bloodstream. It is the principal thyroid hormone transport protein in human serum (Refetoff et al. *Horm. Res.* (1996) 45(3–5):128–138). High serum levels of TBG have been found to cause hyperthyroxinaemia (Leahy et al., *Postgrad Med. J.* (1984) 60(703):324–327). Accordingly, the identification and characterization of TBG proteins is of interest (see Flink et al. *Proc. Natl Acad Sci. USA* (1986) 83(20):7708–7712; Bartalena et al. *Acta Med. Austriaca*, (1988) 15 *Suppl* 1:12–15), including the identification of abnormal TBG proteins (see Refetoff, *Endocr Rev.* (1989) 10(3):275–293). Many efforts are focused on the screening of mammalian recombinant DNA libraries to identify the coding sequences for novel secreted proteins. Examples of screening methods and techniques are described in the literature [see, for example, Klein et al., *Proc. Natl. Acad. Sci.* 93:7108–7113 (1996); U.S. Pat. No. 5,536,637)].

69. PRO1342

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1342.

70. PRO1343

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1343.

71. PRO1480

Semaphorins are a large family of transmembrane and secreted proteins, many of which are expressed in the nervous system. Members of the semaphorin family include both ligands and receptors. (Eckhardt et al., *Mol. Cell. Neurosci.* 9: 409–419 (1997)). Studies have revealed a role for semaphorins in embryonic motor and central nervous system axon guidance and synapse formation. (Catalano et al., *Mol. Cell. Neurosci.*, 11: 173–182 (1998); Kitsukawa et al., *Neuron*, 19: 995–1005 (1997); Yu et al., *Neuron*, 20: 207–220 (1998)). Semaphorins have been shown to induce neuronal growth cone collapse and alter their pathway in vivo. (Shoji et al., *Development*, 125: 1275–1283 (1998)). Members of the semaphorin family have been shown to be immunologically active, inducing cytokine production in human monocytes. (Comeau et al., *Immunity*, 8: 473–482 (1998)). Semaphorins may also play a role in cancer. Expression of a mouse semaphorin gene is known to correlate with metastatic ability in mouse tumor cell lines. (Christensen et al., *Cancer Res.*, 58: 1238–1244 (1998)).

72. PRO1487

Fringe is a protein which specifically blocks serrate-mediated activation of notch in the dorsal compartment of the Drosophila wing imaginal disc (see Fleming et al., *Development*, 124(15):2973–81 (1997); Wu et al. *Science* (1996) 273(5273):355–358). Fringe protein is also involved in vertebrate development where a thickening of the apical ectodermal ridge essential for limb bud outgrowth involves an interaction between dorsal cells that express radical fringe and those that do not (see Wolpert, L. *Philos Trans R Soc Lond B Biol Sci* 1998) 353(1370):871–875; Kengaku et al. *Science* (1998) 280(5367):1274–1277; Cohen et al. *Nat. Genet.* (1997) 16(3):283–288; Johnston et al. *Development* (1997) 124(11):2245–2254; Laufer et al. *Nature* (1997)

386(6623):366–373; Rodriguez-Esteban et al. *Nature* (1997) 386(6623):360–366;).). Therefore, fringe protein is of interest for both its role in development as well as its ability to regulate serrate, particularly serrate's signaling abilities. Also of interest are novel polypeptides which may have a role in development and/or the regulation of serrate-like molecules. Of particular interest are novel polypeptides having homology to fringe protein.

73. PRO1418

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1418.

74. PRO1472

Butyrophilin is a milk glycoprotein that constitutes more than 40% of the total protein associated with the fat globule membrane in mammalian milk. Expression of butyrophilin mRNA has been shown to correlate with the onset of milk fat production toward the end pregnancy and is maintained throughout lactation. Butyrophilin has been identified in bovine, murine and human (see Taylor et al., *Biochim. Biophys. Acta* 1306:1–4 (1996), Ishii et al., *Biochim. Biophys. Acta* 1245:285–292 (1995), Mather et al., *J. Dairy Sci.* 76:3832–3850 (1993), Ogg, et al., *Mamm. Genome,* 7(12): 900–905 (1996), Sato, et al., *J. Biochem.,* 117(1):147–157 (1995) and Banghart et al., *J. Biol. Chem.* 273:4171–4179 (1998)) and is a type I transmembrance protein that is incorporated into the fat globulin membrane. It has been suggested that butyrophilin may play a role as the principle scaffold for the assembly of a complex with xanthine dehydrogenase/oxidase and other proteins that function in the budding and release of milk-fat globules from the apical surface during lactation (Banghart et al., supra). Given that butyrophilin plays a role in mammalian milk production, there is substantial interest in identifying novel butyrophilin homologs. Members of the butyrophilin family are further described in Tazi-Ahnini, et al., *Immunogenetics,* 47(1): 55–63 (1997); Davey, et al., *Gene,* 199(1–2):57–62 (1997); and Mather and Jack, *J. Dairy Sci.,* 76(12):3832–3850 (1993).

75. PRO1461

Proteases are enzymatic proteins which are involved in many biological processes in mammalian and non-mammalian organisms including digestion, protein activation and inactivation, modulation of peptide hormone activity, and alteration of the physical properties of proteins and enzymes. Serine proteases comprise a large class of enzymes that exhibit specific activity toward various serine-containing proteins. Trypsin, which is synthesized by the pancreas and secreted to the small intestine, is a well-characterized serine protease that hydrolyzes peptide bonds of ingested proteins. Trypsin-like proteases have been characterized that are cell-surface proteins (see Farley et al. *Biochim Biophys Acta* (1993) 173(3):350–352; and Leytus et al. *Biochemistry* (1988) 27(3) 1067–1074). It is believed that some of these trypsin-like proteins may be synthesized as a membrane-bound precursor which matures to a soluble and active protease (Yamaoka et al. *J. Biol. Chem* (1998) 273(19):11895–11901).

Because of there importance in metabolism and other enzymatic processes, efforts are being undertaken by both industry and academia to identify new, native serine-like proteases. Many efforts are focused on the screening of mammalian recombinant DNA libraries to identify the coding sequences for novel receptor proteins.

76. PRO1410

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1410.

77. PRO1568

The tetraspanin (or tetraspan) family of proteins has grown to include approximately twenty known genes from various species. The tetraspanins are four transmembrane domain membrane-bound molecules which include for example, CD81, CD82, CD9, CD63, CD37 and CD53. Many of these proteins have a flair for promiscuous associations with other molecules, including lineage-specific proteins, integrins, and other transpanins. In terms of function, they are involved in diverse processes such as cell activation and proliferation, adhesion and motility, differentiation and cancer. One study has proposed that these functions may all relate to their ability to act as "molecular facilitators", grouping specific cell-surface proteins and thus increasing the formation and stability of functional signaling complexes. Maecker, et al., *FASEB,* 11(6):428–42 (1997). Another study concludes that they are responsible for changes in cell morphology, cell-ECM adhesion and cell-signaling. Skubitz, et al., *J. Immunology,* 157:3617–3626 (1996). Thus, new members of this family are of interest.

78. PRO1570

Proteases are enzymatic proteins which are involved in many biological processes in mammalian and non-mammalian organisms including digestion, protein activation and inactivation, modulation of peptide hormone activity, and alteration of the physical properties of proteins and enzymes. Serine proteases comprise a large class of enzymes that exhibit specific activity toward various serine-containing proteins. Trypsin, which is synthesized by the pancreas and secreted to the small intestine, is a well-characterized serine protease that hydrolyzes peptide bonds of ingested proteins. Trypsin-like proteases have been characterized that are cell-surface proteins (see Farley et al. *Biochim Biophys Acta* (1993) 1173(3):350–352; and Leytus et al. *Biochemistry* (1988) 27(3):1067–1074). It is believed that some of these trypsin-like proteins may be synthesized as a membrane-bound precursor which matures to a soluble and active protease (Yamaoka et al. *J. Biol. Chem* (1998) 273(19):11895–11901).

Of particular interest are human colon carcinoma derived serine proteases SP59, SP60 and SP67 which may be useful to screen for specific inhibitors or modulators to use in treatment of associated disease states and disorders related to these proteins. In Japanese patent J09149790-A, SP60 is reported to be identified, having accession number P_W22986 and 233 amino acids.

79. PRO1317

Members of the semaphorin family of glycoproteins play important roles in the developing nervous system, and more particularly in axonal guidance. Semaphorins have been identified in the human immune system, where they are believed to play functional roles including B-cell signaling (Hall et al. *Proc. Natl. Acad. Sci* (1996) 93(21):11780–50). A human semaphorin gene, useful in the diagnosis of nervous system an immune disorders, is disclosed in Japanese Pat. No. J10155490-A, published Jun. 16, 1998. The identification of additional members of the semaphorin family if of interest.

80. PRO1780

Enzymatic proteins that may be implicated in metabolic diseases or disorders are of particular interest. The enzymatic addition of sugars to fat-soluble chemicals is an important process that increases their solubility in water and aids in their excretion. In mammals, glucuronic acid is the main sugar that is used to prevent the waste products of metabolism and fat-soluble chemicals from reaching toxic levels in the body. The UDP glucuronosyltransferases that carry out this reaction are part of a super family of UDP glycosyltransferases found in animals, plants and bacteria. In the liver, UDP-glucuronosyltransferase conjugates bilirubin. There are a number of conditions which affect UDP-glucuronosyltransferase activity resulting in unconjugated hyperbilirubinemia. These conditions include genetic disorders such as Crigler-Najjar Syndrome (see Jurgen et al., *Biochem. J.* (1996) 314:477–483) and Gilbert syndrome, as well as acquired conditions such as Lucey-Driscoll Syndrome. Accordingly, the identification of novel members of the glucuronosyltransferase family is of interest (see Tukey et al., *J. Biol. Chem.* (1993) 268(20):15260–6; and WO9212987-A).

81. PRO1486

The cerebellum contains a hexadecapeptide, termed cerebellin, that is conserved in sequence from human to chicken. Three independent, overlapping cDNA clones have been isolated from a human cerebellum cDNA library that encode the cerebellin sequence. The longest clone codes for a protein of 193 amino acids generally termed precerebellin, or a cerebellin precursor. This protein has a significant similarity to the globular region of the B chain of human complement component Clq. The region of relatedness extends approximately over 145 amino acids located in the carboxyl terminus of both proteins. Unlike Clq B chain, no collagen-like motifs are present in the amino-terminal regions of precerebellin. It is believed that cerebellin is not liberated from precerebellin by the classical dibasic amino acid protealytic cleavage mechanism seen in many neuropeptide precursors. The cerebellin precursor has been associated with synaptic physiology. Urade, et al., *PNAS, USA*, 88(3):1069–1073 (1991). Cerebellin, its precursor, and related molecules, particularly those having sequence identity with cerebellin, are therefore of interest.

82. PRO1433

Efforts are being undertaken by both industry and academia to identify new, native transmembrane and receptor proteins. Many efforts are focused on the screening of mammalian recombinant DNA libraries to identify the coding sequences for novel transmembrane proteins. We herein describe the identification and characterization of a novel transmembrane polypeptide designated herein as PRO1433.

83. PRO1490

Enzymatic proteins play important roles in the chemical reactions involved in the digestion of foods, the biosynthesis of macromolecules, the controlled release and utilization of chemical energy, and other processes necessary to sustain life. Acyltransferases are enzymes which acylate moieties. For example, acyl-glycerol-phosphate acyltransferases can act on lysophosphatidic acid as a substrate. The lysophosphatidic acid is converted to phophatidic acid and thus plays a role in forming phosphatidylethanolamine found in membranes. See, Brown, et al., *Plant Mol. Biol.*, 26(1):211–223 (1994). Moreover, 1-acyl-sn-glycerol-3-phosphate acyltransferase (LPAAT) is an enzymatic protein that shows a preference for medium-chain-length fatty acyl-coenzyme A substrates. See, Knutson et al., *Plant Physiol.* 109:999–1006 (1995)). Thus, acyltransferases play an important role in the biosynthesis of molecules requiring acylation.

We herein describe the identification and characterization of novel polypeptides having homology to a 1-acyl-sn-glycerol-3-phosphate acyltransferase protein, designated herein as PRO1490 polypeptides.

84. PRO1482

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1482.

85. PRO1446

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1446.

86. PRO1558

Methyltransferase enzymes catalyze the transfer of methyl groups from a donor molecule to an acceptor molecule. Methyltransferase enzymes play extremely important roles in a number of different biological processes including, for example, in the electron transport chain in the plasma membrane in prokaryotes and in the inner mitochondrial membrane in eukaryotic cells (see, e.g., Barkovich et al., *J. Biol. Chem.* 272:9182–9188 (1997), Dibrov et al., *J. Biol. Chem.* 272:9175–9181 (1997), Lee et al., *J. Bacteriol.* 179:1748–1754 (1997) and Marbois et al., *Arch. Biochem. Biophys.* 313:83–88 (1994)). Methyltransferase enzymes have been shown to be essential for the biosynthesis of ubiquinone (coenzyme Q) and menaquinone (vitamin K2), both of which are essential isoprenoid quinone components of the respiratory electron transport chain. Given the obvious importance of the methyltransferase enzymes, there is substantial interest in identifying novel polypeptide homologs of the methyltransferases. We herein describe the identification and characterization of a novel polypeptide having homology to methyltransferase enzymes, designated herein as PRO1558 polypeptides.

87. PRO1604

The identification of novel growth factors is of particular interest because of the roles they play in inducing cellular growth, proliferation and differentiation in both normal states and abnormal states. The identification of growth factors that are over- or under-expressed in abnormal tissues (e.g. tumors) may lead to the development of diagnostic tools and therapeutic agents. Growth factors have been isolated from hepatoma-derived cell lines. Hepatoma-derived growth factors have been isolated from mouse (Japanese Pat. No. J09313185-A, published Dec. 9, 1997) and human (Japanese Pat. No. J06343470-A, published Dec. 20, 1994) tissues. A hepatoma-derived growth factor, isolated from a human hepatoma-derived cell line, has been found to be ubiquitously expressed in several tumor-derived cell lines, as well as in normal tissues (Nakamura et al., *J. Biol. Chem* (1994) 269(40):25143–9). The growth factor was determined to be a novel heparin-binding protein that is mitogenic for fibroblasts.

88. PRO1491

The neuronal cell body is usually round like any other cell. However, these cells have structures, also referred to as "processes", which grow from them to form synaptic connections. Some of these processes carry information away from the cell body; sometimes over very long distances.

These long and thin processes are axons. The axon is a thin, static tube. Other processes carry information either towards the cell body, or both towards and away from the cell body. These shorter and usually thicker processes are called dendrites. Both axons and dendrites are called neurites.

During development and the growth stage of neurons, neurites are formed by means of growth cones. A growth cone is the growing tip of a neurite. The growth cone is flattened and highly motile. It is where new material is added and further extension of the axon originates. Controlling where the growth cone crawls controls were the axon will be laid down and thus where it will be present.

The growth cone has several definable parts. The thin, flattened, veil-like processes that stick out and retract from the leading edge are called lamellipodia. The needle-like processes that stick out and retract from the leading edge are called microspikes or filopodia. These are the structures involved in pushing the leading edge of the growth cone forward.

The accurate navigation of growth cones to their appropriate targets requires that they recognize and respond to navigational cues in their immediate environment. Some of these cues encourage extension into certain areas whereas others discourage extension into others. Well characterized molecules that encourage neurite outgrowth in vitro include the extracellular matrix molecule laminin and the neuronal cell surface molecule L1/G4/8D9. These molecules which promote neurite extension are generally widely distributed throughout the body. Laminin immunoreactivity is reasonably widespread in the developing central and peripheral nervous systems. Similarly, L1/G4/8D9 is present on a wide variety of neuronal processes in the developing central nervous system, particularly long projecting axons. It is, therefore, unclear whether the known outgrowth promoting molecules play an important role in self-specific choices growth cones make as they decide between possible routes. Instead, their function is believed to provide a generally permissive environment in which growth cones extend and respond to more specific navigational cues.

Among these more specific cues are molecules that inhibit the motility of particular growth cones. Growth cones have been observed to lose their motile morphology and cease advancing (collapse) on contact with other neurites of different types. Territory formation in vitro may mean the manifestation of a process that leads to selective fasciculation in vivo. Some growth cones have been observed to crawl along specific axonal pathways, or stereotype sequences of axonal pathways in developing embryos. Specific motility inhibiting effects could determine which of several alternative pathways a growth cone will extend on. Growth cones would be expected to prefer growing on axons that do not induce them to collapse while shunning those that do.

It has been observed that, for example, sympathetic growth cones will be inhibited or collapse when coming in contact with retinal neurites. Likewise, growth cones of retinal neurites will collapse when coming in contact with sympathetic neurites. It is believed that such cell activity is achieved through the presence of receptors which specifically respond to specific growth inhibition cues by the molecules which transmit specific cues pertaining to growth. Cues are believed to be present on cell surfaces, particularly on axon surfaces.

When nerve damage occurs, repair is impeded or incapable of occurring due to the failure of neurites to replace damaged axons or dendrites. If an existing neurite is damaged, severed or destroyed, a new neurite is incapable of growing out from the cell body to replace it. The presence of molecules which inhibit neurite growth are believed to be responsible for the difficulty in neurite regeneration. Collapsins are proteins that function to modulate the activity of molecules which modulate growth cone extension.

We herein describe the identification and characterization of novel polypeptides having homology to a collapsin protein, designated herein as PRO1491 polypeptides.

89. PRO1431

The transduction of intracellular signaling is crucial to cell processing such as differentiation, motility and division. Such signal transduction is believed to occur throughout the cell in the form of complex interactions between proteins. Such protein-protein interactions are often mediated by modular domains within signaling proteins. As a result, signal transduction is now modeled as a system in which molecules act in a combination, and the composition of that combination, determines the signal.

Src homology domains (e.g., SH2 and SH3) are two domains found in regions of sequence similarity of proteins involved in signal transduction. Early work on the oncogenic tyrosine kinase Src identified the SH2 domain. Since then, SH2 and SH3 domains have been found in many diverse proteins, making them among the most common type of structural motif. SH2 and SH3 domains are modular in that they fold independently of the protein that contains them, their secondary structure places N- and C-termini close to one another in space, and they appear at variable locations (anywhere from N- to C-terminal) from one protein of the next (Cohen et al., Cell 80: 237–348, 1995).

Early studies that mutated the SH2 or SH3 domain showed that these two domains were important for function, but it was not until the cloning of unrelated families of signaling proteins such as RAS-GAP, and the Crk oncogene that the modular nature of these domains was revealed. These latter experiments demonstrated that RAS-GAP and Crk bound tightly to receptor tyrosine kinases upon ligand stimulation. Follow-up studies demonstrated that the mechanism of this binding was through the SH2 domain and that receptor autophosphorylation was required. Such a finding implied that activation of the receptor tyrosine kinase could be viewed as a means of changing the binding aspect of the intracellular domain, and the receptor-SH2 containing protein interaction would initiate the signal transduction cascade.

SH3 domains have a more general function than that which is purported for SH2. SH3 binding proteins have been isolated by screening bacteriophage expression libraries with labeled SH3 domains. The results of these experiments showed that SH3 domains would bind to short proline-rich peptides, in particular the motif PxxP. Based on the level of knowledge present at the time of the preparation of the present patent application, all of the SH3 binding sites identified have the property of being proline rich. Binding of an SH3 domain is independent of covalent modification of the binding site, such as phosphorylation as occurs with the SH2 domain. As a result, SH3-ligand interactions are usually constitutive and not inducible, although exceptions do exist. In general, SH3 domains are less likely to act as signal "switches" than as a means of assembling protein complexes via moderate-affinity interactions. Such moderate affinity interactions also imply that the SH3-mediated interactions will be relatively short in duration and remodeled in response to changes in concentration of binding partners.

The resolution of binding characteristics of SH2 and SH3 domains has led to proposed compounds which would block signal transduction. Peptidomimetic ligands based on the sequence of target proteins for SH2 and SH3 domains may represent new lead compounds for the therapy of proliferative diseases that are dependent upon constitutively activated tyrosine kinases (e.g., BCR/ABL in chronic myelogenous and acute lymphocytic leukemias or HER-2/Neu in breast and ovarian cancer).

90. PRO1563

Cellular disintegrin and metalloproteinase (ADAMs) are a family of genes with a sequence similar to those of snake venom metalloproteinases and disintegrins. The ADAMTS-1 gene encodes a new type of ADAM protein with respect to possessing the thrombospondin (TSP) type I motifs, the expression of which is associated with the inflammatory process (Kuno et al., *J. Biol. Chem.* 273:13912–13917 (1998), Kuno et al., *Genomics* 46:466–471 (1997) and Kuno et al., *J. Biol. Chem.* 272:556–562 (1997)). Expression of the ADAMTS-1 ge is induced in kidney and heart by in vivo administration of lipopolysaccharide, suggesting a possible role in the inflammation reaction. In this regard, the ADAMTS-1 protein has been suggested as playing a possible role in various inflammatory processes as well as in the development of cancer cachexia (Kuno et al., 1998, supra). We herein describe the identification and characterization of novel polypeptides having homology to ADAMTS-1 protein, designated herein as PRO1563 polypeptides.

91. PRO1565

Chondromodulin proteins are cartilage-generated matrix components that synergistically stimulate the growth and differentiation of chondrocytes (Suzuki, *Connect. Tissue Res.* 35:303–307 (1996)). More specifically, chondromodulin-I functions to inhibit the proliferation of vascular endothelial cells and tube formation, thereby functioning to stimulate cartilage growth and inhibiting replacing cartilage by bone in an early stage. Chondromodulin-II, while not capable of inhibiting vascularization like chondromodulin-I, also functions to stimulate osteoclast differentiation and cartilage growth. As such, these two polypeptides are essential for the regulation of the formation of cartilage and endochondral bone structures. Given the extremely important physiological roles played by the chondromodulin proteins, there is significant interest in identifying and characterizing novel polypeptides having homology to these proteins. We herein describe the identification and characterization of novel polypeptides having homology to chondromodulin-I protein, designated herein as PRO1565 polypeptides.

92. PRO1571

*Clostridium perfringens* enterotoxin (CPE) is considered to be the virulence factor responsible for causing the symptoms of *C. perfringens* type A food poisoning and may also be involved in other human and veterinary illnesses (McClane, *Toxicon.* 34:1335–1343 (1996)). CPE carries out its adverse cellular functions by binding to an approximately 50 kD cell surface receptor protein designated the *Clostridium perfringens* enterotoxin receptor (CPE-R) to form an approximately 90,000 kD complex on the surface of the cell. cDNAs encoding the CPE-R protein have been identified characterized in both human and mouse (Katahira et al.,*J. Cell Biol.* 136:1239–1247 (1997) and Katahira et al., *J. Biol. Chem.* 272:26652–26658 (1997)). Since the CPE toxin has been reported to cause a variety of illnesses in mammalian hosts and those illnesses are initiated by binding of the CPE toxin to the CPE-R, there is significant interest in identifying novel CPE-R homologs. We herein describe the identification and characterization of novel polypeptides having homology to the CPE-R, designated herein as PRO1679 polypeptides.

93. PRO1572

*Clostridium perfringens* enterotoxin utilizes two structurally related membrane proteins as functional receptors in vivo. Human and mouse cDNAs showing homology to the *Clostridium* enterotoxin receptor (CPE-R) gene have previously been cloned as described in Katahira, et al., *J. Biol. Chem.,* 272(42):26652–8 (1997). They have been classified into two groups, the Vero cell CPE receptor homologues and rat androgen withdrawal apoptosis protein (RVP1). These receptors are thus of interest as are related molecules. Of particular interest is the use of these receptors and related molecules in the identification of modulators of these receptors.

Also of interest are members of the claudin family and molecules related thereto. Claudins are integral membrane proteins localizing at tight junctions with no sequence similarity to occludin. Furuse, et al., *J. Cell Biol.,* 141(7): 1539–50 (1998).

94. PRO1573

*Clostridium perfringens* enterotoxin utilizes two structurally related membrane proteins as functional receptors in vivo. Human and mouse cDNAs showing homology to the *Clostridium* enterotoxin receptor (CPE-R) gene have previously been cloned as described in Katahira, et al., *J. Biol. Chem.,* 272(42):26652–8 (1997). They have been classified into two groups, the Vero cell CPE receptor homologues and rat androgen withdrawal apoptosis protein (RVP1). These receptors are thus of interest as are related molecules. Of particular interest is the use of these receptors and related molecules in the identification of modulators of these receptors.

Also of interest is the ventral prostate. 1 protein (RVP. 1) which is transcriptionally induced in the regressing rat prostate after castration. This protein is further described in Peacock, et al., *Genomics,* 46(3):443–9 (1997).

95. PRO1488

*Clostridium perfringens* enterotoxin utilizes two structurally related membrane proteins as functional receptors in vivo. Human and mouse cDNAs showing homology to the *Clostridium* enterotoxin receptor (CPE-R) gene have previously been cloned as described in Katahira, et al., *J. Biol. Chem.,* 272(42):26652–8 (1997), and Katahira, et al.,*J. Cell Biol.,* 136(6):1239–1247(1997). They have been classified into two groups, the Vero cell CPE receptor homologues and rat androgen withdrawal apoptosis protein (RVP1). These receptors are thus of interest as are related molecules. Of particular interest is the use of these receptors and related molecules in the identification of modulators of these receptors.

Efforts are being undertaken by both industry and academia to identify new, native receptor proteins. Many efforts are focused on the screening of mammalian recombinant DNA libraries to identify the coding sequences for novel receptor proteins.

96. PRO1489

*Clostridium perfringens* enterotoxin (CPE) is considered to be the virulence factor responsible for causing the symptoms of *C. perfringens* type A food poisoning and may also be involved in other human and veterinary illnesses (McClane, *Toxicon.* 34:1335–1343 (1996)). CPE carries out its adverse cellular functions by binding to an approximately 50 kD cell surface receptor protein designated the *Clostridium perfringens* enterotoxin receptor (CPE-R) to form an approximately 90,000 kD complex on the surface of the cell. cDNAs encoding the CPE-R protein have been identified characterized in both human and mouse (Katahira et al.,*J. Cell Biol.* 136:1239–1247 (1997) and Katahira et al., J. Biol. Chem. 272:26652–26658 (1997)). Since the CPE toxin has been reported to cause a variety of illnesses in mammalian hosts and those illnesses are initiated by binding of the CPE toxin to the CPE-R, there is significant interest in identifying novel CPE-R homologs. We herein describe the identification and characterization of novel polypeptides having homology to the CPE-R, designated herein as PRO1489 polypeptides.

97. PRO1474

Avian egg whites are a rich source of protein inhibitors of proteinases belonging to all four mechanistic classes. Ovomucoid and ovoinhibitor are multidomain Kazal-type inhibitors with each domain containing an actual or putative reactive site for a serine proteinase. Cystatin is a cysteine proteinase inhibitor, while ovostatin inhibits proteinases of all four mechanistic classes. For a review of these inhibitors, see Saxena and Tayyab, *Cell Mol. Life Sci.,* 53(1):13–23 (1997). New members of protein inhibitors of proteinases are of interest, particularly those having sequence identity with known inhibitors such as ovomucoid.

Serine protease inhibitors in general are of interest. Serine proteases such as neuropsin have been indicated as associated with extracellular matrix modifications and cell migrations. See, generally, Chen, et al., *Neurosci.,* 7(2): 5088–5097 (1995) and Chen, et al., *J. Histochem. Cytochem.,* 46:313–320 (1998). Another serine protease, the enamel matrix serine proteinase, is associated with the degradation of organic matrix in teeth. Simmer, et al., *J. Dent. Res.,* 77(2):377–386 (1998), Overall and Limeback, Biochem J., 256(3):965–972 (1988), and Moradian-Oldak, *Connect. Tissue Res.,* 35(1–4):231–238 (1996). Thus, inhibitors of these proteases are of interest in the case that these mechanisms require control.

98. PRO1508

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1508.

99. PRO1555

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO1555.

100. PRO1485

Lysozymes are secreted enzymes that preferentially hydrolyze the [beta]-1,4 glucosidic linkages between N-acetylnuramic acid and N-acetylgucosamine which occur in the mucopeptide cell wall structure of certain microoganisms. Lysozyme is of widespread distribution in animals and plants. It has been found in mammalian secretions and tissues including saliva, tears, milk, cervical mucus, leucocytes, kidneys, etc. The identification of new members of the lysozyme family of proteins is of interest because of the variety of roles lysozymes play in metabolic function and dysfunction. Abnormal levels of lysozymes have been implicated in various disease states. Lysozymes have been reported to have anti-microbial, analgesic, and antinociceptive properties. Additional characteristics and possible uses of lysozymes are described in U.S. Pat. No. 5,618,712.

Of particular interest is lysozyme C which has been recruited as a digestive enzyme in the stomachs of creatures needing to retrieve nutrients from microorganisms in fermented food. The history of lysozyme C and related proteins are further described in Qasba and Kumar, *Crit. Rev. Biochem. Mol. Biol.,* 32(4):255–306 (1997); Irwin, *EXS,* 75:347–361 (1996)

101. PRO1564

Glycosylation is a common and complex form of post-translational protein modification. Although a large and increasing number of unique structures is known to exist, most arise from a series of common synthetic intermediates and differ at their periphery glycosyltransferases, which recognize both the oligosaccharide acceptor and features of the underlying protein. UDP-N-acetyl-alpha-D-galactosamine:polypeptide N-acetylgalactosaminyltransferase is an enzymatic protein that initiates O-glycosylation of specific serine and threonine amino acids in proteins by adding N-acetylgalactosamine to the hydroxy group of these amino acids. Since numerous important biological and physiological events are regulated by protein glycosylation, there is significant interest in identifying and characterizing novel polypeptides having homology to the known glycosylation proteins. We herein describe the identification and characterization of novel polypeptides having homology to an N-acetylgalactosaminyltransferase protein, designated herein as PRO1564 polypeptides.

102. PRO1755

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO1755.

103. PRO1757

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO1757.

104. PRO1758

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1758.

105. PRO1575

Protein Disulfide Isomerase (PDI) enhances formation of disulfide bonds in human serum albumin (HSA). Consequently, PDI assists in the formation of the overall structure of human serum albumin. Co-expression of PDI with human serum albumin increases secretion of HSA by reducing the chance of HSA structural instability and destruction by cellular proteases. Co-expression of PDI and HSA improved localization in the endoplasmic reticulum of eukaryotic cells. (Hayano et al., EP-50941-A (1992)). PDI and the beta-subunit of human prolyl 4-hydroxylase have been shown to be products of the same gene. (Pihlajaniemi et al., *EMBO J.,* 6:643–49 (1987)). In addition, copies of the CGHC-containing active site sequences of PDI have been found in an abundant luminal endoplasmic reticulum protein, Erp72. (Mazzarella et al., *J. Biol. Chem.,* 2:1094–1101 (1990)).

106. PRO1787

Multiple de novo MPZ (P0) point mutations have been identified in a sporadic Dejerine-Sottas (DDS) case. Warner, et al., Hum. Mutat., 10(1):21–4 (1997). DDS is a severe demyelinating peripheral neuropathy with onset in infancy, and has been associated with mutations in either PMP22 or MPZ. Moreover, mutational analysis of the MPZ, PMP22 and Cx32 genes in patients of Spanish ancestry with Charcot-Marie-Tooth disease and hereditary neuropathy with liability to pressure palsies have been reported on. Bort, et al., Hum. Genet., 99(6):746–54 (1997). Myelin glycoprotein P0 has been reported on in a number of other studies as well (Blanquet-Grossard, et al., Clin. Genet., 48(6):281–3 (1995), Hayasaka, et al., Nat. Genet., 5(1):31–4 (1993) and Saavedra, et al., J. Mol. Evol., 29(2):149–56 (1989). Thus, proteins which may belong to the myelin p0 family are of interest.

107. PRO1781

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO1781.

108. PRO1556

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO1556.

109. PRO1759

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO1759.

110. PRO1760

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1760.

111. PRO1561

Phospholipase A2 (PLA2) is a protein which hydrolyzes a 2-acyl ester bond of phospholipids, and examples thereof include cytosolic PLA2 and secretory PLA2 which can be clearly distinguished from each other. It has been known that the cytosolic PLA2 (cPLA2) selectively hydrolyzes phospholipids containing arachidonic acid of which 2-position is esterified. Given these important biological activities, there is significant interest in identifying and characterizing novel polypeptides having homology to phospholipase A2 proteins. We herein describe the identification and characterization of novel polypeptides having homology to human phospholipase A2 protein, designated herein as PRO1561 polypeptides.

112. PRO1567

Colon specific genes (CSGs) and their expression products are described in published international application WO9639419. They are useful diagnostic markers for colon cancer and for colon cancer metastasis and can also be used to screen for potential pharmaceutical and diagnostic agents. The identification of new members of the CSG family is of interest.

113. PRO1693

Insulin-like growth factors have both growth-promoting and insulin-like activities. There are two well characterized plasma IGF-binding proteins in human. The larger protein is an acid-labile protein of 53K which circulates mostly as a 125 to 150 kD complex thought to be composed of IGF-I or IGF-II, the binding protein itself and an acid-labile non-IGF-binding protein with an approximate molecular mass of 100K kD. The smaller protein has an apparent molecular mass of 28K in the non-reduced form and 34K when reduced. These IGF-binding proteins have been shown to play important roles in the physiological activities played by the insulin-like growth factor proteins. As such, there is substantial interest in identifying and characterizing novel polypeptides having homology to the insulin-like growth factor binding proteins. We herein describe the identification and characterization of novel polypeptides having homology to an insulin-like growth factor binding protein, designated herein as PRO1693 polypeptides.

114. PRO1784

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO1784.

115. PRO1605

N-acetylglucosaminyltransferase proteins comprise a family of enzymes that provide for a variety of important biological functions in the mammalian organism. As an example, UDP-N-acetylglucosamine: alpha-3-D-mannoside beat-1,2-N-acetylglucosaminyltransferase I is an enzymatic protein that catalyzes an essential first step in the conversion of high-mannose N-glycans to hybrid and complex N-glycans (Sarkar et al., Proc. Natl. Acad. Sci. USA. 88:234–238 (1991). Given the obvious importance of the N-acetylglucosaminyltransferase enzymes, there is significant interest in the identification and characterization of novel polypeptides having homology to an N-acetylglucosaminyltransferase protein. We herein describe the identification and characterization of novel polypeptides having homology to an N-acetylglucosaminyltransferase protein, designated herein as PRO1605 polypeptides.

116. PRO1788

Protein-protein interactions include receptor and antigen complexes and signaling mechanisms. As more is known about the structural and functional mechanisms underlying protein-protein interactions, protein-protein interactions can be more easily manipulated to regulate the particular result of the protein-protein interaction. Thus, the underlying mechanisms of protein-protein interactions are of interest to the scientific and medical community.

Proteins containing leucine-rich repeats are thought to be involved in protein-protein interactions. Leucine-rich repeats are short sequence motifs present in a number of proteins with diverse functions and cellular locations. The crystal structure of ribonuclease inhibitor protein has revealed that leucine-rich repeats correspond to beta-alpha structural units. These units are arranged so that they form a parallel beta-sheet with one surface exposed to solvent, so that the protein acquires an unusual, nonglobular shape. These two features have been indicated as responsible for the protein-binding functions of proteins containing leucine-rich repeats. See, Kobe and Deisenhofer, *Trends Biochem. Sci.,* 19(10):415–421 (October 1994).

A study has been reported on leucine-rich proteoglycans which serve as tissue organizers, orienting and ordering collagen fibrils during ontogeny and are involved in pathological processes such as wound healing, tissue repair, and tumor stroma formation. Iozzo, R. V., *Crit. Rev. Biochem. Mol. Biol.,* 32(2):141–174 (1997). Others studies implicating leucine rich proteins in wound healing and tissue repair have been reported including De La Salle, C., et al., *Vouv. Rev. Fr. Hematol.* (Germany), 37(4):215–222 (1995), reporting mutations in the leucine rich motif in a complex associated with the bleeding disorder Bernard-Soulier syndrome; Chlemetson, K. J., *Thromb. Haemost.* (Germany), 74(1):111–116 (July 1995), reporting that platelets have leucine rich repeats and Ruoslahti, E. I., et al.; and WO9110727-A by La Jolla Cancer Research Foundation, reporting that decorin binding to transforming growth factor-s has involvement in a treatment for cancer, wound healing and scarring. Related by function to this group of proteins is the insulin like growth factor (IGF), in that it is useful in wound-healing and associated therapies concerned with re-growth of tissue, such as connective tissue, skin and bone; in promoting body growth in humans and animals; and in stimulating other growth-related processes. The acid labile subunit of IGF (ALS) is also of interest in that it increases the half-life of IGF and is part of the IGF complex in vivo. Ollendorff, V., et al., *Cell Growth Differ,* 5(2):213–219 (February 1994) identified the GARP gene which encodes a leucine-rich repeat-containing protein that has structural similarities with human GP Ib alpha and GP V platelet proteins, and with the Chaoptin, Toll, and Connectin adhesion molecules of Drosophila.

Another protein which has been reported to have leucine-rich repeats is the SLIT protein which has been reported to be useful in treating neurodegenerative diseases such as Alzheimer's disease, nerve damage such as in Parkinson's disease, and for diagnosis of cancer, see, Artavanistsakonas, S. and Rothberg, J. M., WO9210518-A1 by Yale University. Of particular interest is LIG-1, a membrane glycoprotein that is expressed specifically in glial cells in the mouse brain, and has leucine rich repeats and immunoglobulin-like domains. Suzuki, et al., *J. Biol. Chem.* (U.S.), 271(37): 22522 (1996). Other studies reporting on the biological functions of proteins having leucine rich repeats include: Tayar, N., et al., *Mol. Cell Endocrinol.,* (Ireland), 125(1–2): 65–70 (December 1996) (gonadotropin receptor involvement); Miura, Y., et al., *Nippon Rinsho* (Japan 54(7): 1784–1789 (July 1996) (apoptosis involvement); Harris, P. C., et al., *J. Am. Soc. Nephrol.,* 6(4):1125–1133 (October 1995) (kidney disease involvement); and Almeida, A., et al., *Oncogene* 16(23):2997–3002 (June 1998) (malignant glioma involvement).

117. PRO1801

Interleukin-10 (IL-10) is a pleiotropic immunosuppressive cytokine that has been implicated as an important regulator of the functions of myeloid and lymphoid cells. It has been demonstrated that IL-10 functions as a potent inhibitor of the activation of the synthesis of various inflammatory cytokines including, for example, IL-1, IL-6, IFN-γ and TNF-α (Gesser et al., *Proc. Natl. Acad. Sci. USA* 94:14620–14625 (1997)) Moreover, IL-10 has been demonstrated to strongly inhibit several of the accessory activities of macrophages, thereby functioning as a potent suppressor of the effector functions of macrophages, T-cells and NK cells (Kuhn et al., *Cell* 75:263–274 (1993)). Furthermore, IL-10 has been strongly implicated in the regulation of B-cell, mast cell and thymocyte differentiation.

IL-10 was independently identified in two separate lines of experiments. First, cDNA clones encoding murine IL-10 were identified based upon the expression of cytokine synthesis inhibitory factor (Moore et al., *Science* 248:1230–1234 (1990)), wherein the human IL-10 counterpart cDNAs were subsequently identified by cross-hybridization with the murine IL-10 cDNA (Viera et al., *Proc. Natl. Acad. Sci. USA* 88:1172–1176 (1991)). Additionally, IL-10 was independently identified as a B-cell-derived mediator which functioned to co-stimulate active thymocytes (Suda et al., *Cell Immunol.* 129:228 (1990)).

Recently, a novel cytokine polypeptide which is member of the IL-10-related cytokine family has been identified and characterized. This novel secreted cytokine, designated IL-19, is a 177 amino acid polypeptide having a molecular weight of approximately 20.4 kD (see WO 98/08870, published Mar. 5, 1998). It has been reported that IL-19 is specifically expressed by activated monocytes, wherein increased and/or decreased levels of IL-19 may be associated with one or more physiological disorders that are associated with increased or decreased levels of cytokine production (see WO 98/08870). Specifically, IL-19 is suggested as being capable of inhibiting the synthesis of inflammatory cytokines by cells of the immune system.

Given the obvious importance of the various cytokine polypeptides and, more specifically, immunosuppressive cytokines such as IL-10 and potentially IL-19, there is significant interest in the identification and characterization of novel cytokine polypeptides having homology to IL-10 and/or IL-19. We herein describe the identification and characterization of novel polypeptides having homology to IL-19, designated herein as PRO1801 polypeptides.

118. UCP4

Uncoupling proteins or "UCPs", believed to play a role in the metabolic process, have been reported in the literature. UCPs were first found and described in the brown fat cells of hibernating animals, such as bears. UCPs were believed to help such hibernators and other cold-weather adapted animals maintain core body temperatures in cold weather by raising their body's resting metabolic rate. Because humans possess relatively small quantities of brown adipose tissue, UCPs were originally thought to play a minor role in human metabolism.

Several different human uncoupling proteins have now been described. [See, generally, Gura, *Science,* 280:1369–1370 (1998)]. The human uncoupling protein referred to as UCP1 was identified by Nicholls et al. Nicholls et al. showed that the inner membrane of brown fat cell mitochondria was very permeable to proteins, and the investigators traced the observed permeability to a protein, called UCP1, in the mitochondrial membrane. Nicholls et al. reported that the UCPI, by creating such permeability, reduced the number of ATPs that can be made from a food source, thus raising body metabolic rate and generating heat. [Nicholls et al., *Physiol. Rev.,* 64, 1–64 (1984)].

It was later found that UCP1 is indeed expressed only in brown adipose tissue [Bouillaud et al., *Proc. Natl. Acad. Sci.,* 82:445–448 (1985); Jacobsson et al., *J. Biol. Chem.,* 260:16250–16254 (1985)]. Genetic mapping studies have shown that the human UCP1 gene is located on chromosome 4. [Cassard et al., *J. Cell. Biochem.,* 43:255–264 (1990)].

Another human UCP, referred to as UCPH or UCP2, has also been described. [Gimeno et al., Diabetes, 46:900–906 (1997); Fleury et al., Nat. Genet., 15:269–272 (1997); Boss et al., FEBS Letters, 408:39–42 (1997); see also, Wolf, Nutr. Rev., 55:178–179 (1997)]. Fleury et al. teach that the UCP2 protein has 59% amino acid identity to UCP1, and that UCP2 maps to regions of human chromosome 11 which have been linked to hyperinsulinaemia and obesity. [Fleury et al., supra]. It has also been reported that UCP2 is expressed in a variety of adult tissues, such as brain and muscle and fat cells. [Gimeno et al., supra, and Fleury et al., supra].

A third human UCP, UCP3, was recently described in Boss et al., supra; Vidal-Puig et al., Biochem. Biophys. Res. Comm., 235:79–82 (1997); Solanes et al., J. Biol. Chem., 272:25433–25436 (1997); and Gong et al., J. Biol. Chem., 272:24129–24132 (1997). [See also Great Britain Patent No. 9716886]. Solanes et al. report that unlike UCP1 and UCP2, UCP3 is expressed preferentially in human skeletal muscle, and that the UCP3 gene maps to human chromosome 11, adjacent to the UCP2 gene. [Solanes et al., supra]. Gong et al. describe that the UCP3 expression can be regulated by known thermogenic stimuli, such as thyroid hormone, beta3-andrenergic agonists and leptin. [Gong et al., supra].

119. PRO193

Efforts are being undertaken by both industry and academia to identify new, native transmembrane proteins. Many efforts are focused on the screening of mammalian recombinant DNA libraries to identify the coding sequences for novel transmembrane proteins. We herein describe the identification and characterization of a novel transmembrane protein designated herein as PRO193.

120. PRO1130

Polypeptides such as the human 2–19 protein may function as cytokines. Cytokines are low molecular weight proteins which function to stimulate or inhibit the differentiation, proliferation or function of immune cells. Cytokine proteins often act as intercellular messengers and have multiple physiological effects. Given the physiological importance of immune mechanisms in vivo, efforts are currently being undertaken to identify new, native proteins which are involved in effecting the immune system. We describe herein the identification of a novel polypeptide which has sequence similarity to the human 2–19 protein.

121. PRO1335

Carbonic anhydrase is an enzymatic protein that which aids carbon dioxide transport and release in the mammalian blood system by catalyzing the synthesis (and the dehydration) of carbonic acid from (and to) carbon dioxide and water. Thus, the actions of carbonic anhydrase are essential for a variety of important physiological reactions in the mammal. As such, there is significant interest in the identification and characterization of novel polypeptides having homology to carbonic anhydrase. We herein describe the identification and characterization of novel polypeptides having homology to carbonic anhydrase, designated herein as PRO1335 polypeptides.

122. PRO1329

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1329.

123. PRO1550

Efforts are being undertaken by both industry and academia to identify new, native secreted proteins. Many efforts are focused on the screening of mammalian recombinant DNA libraries to identify the coding sequences for novel secreted proteins. We herein describe the identification and characterization of a novel secreted protein designated herein as PRO1550.

SUMMARY OF THE INVENTION

1. PRO1560

A cDNA clone (DNA19902-1669) has been identified that encodes a novel polypeptide believed to be a novel member of the tetraspan family, designated in the present application as "PRO1560."

In one embodiment, the invention provides an isolated nucleic acid molecule comprising DNA encoding a PRO1560 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1560 polypeptide having the sequence of amino acid residues from 1 or about 43 to about 245, inclusive of FIG. 2 (SEQ ID NO:4), or (b) the complement of the DNA molecule of (a).

In another aspect, the invention concerns an isolated nucleic acid molecule encoding a PRO1560 polypeptide comprising DNA hybridizing to the complement of the nucleic acid between about residues 167 and about 775, inclusive, of FIG. 1 (SEQ ID NO:3). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203454 (DNA19902-1669), or (b) the complement of the DNA molecule of (a). In a preferred embodiment, the nucleic acid comprises a DNA encoding the same mature polypeptide encoded by the human protein cDNA in ATCC Deposit No. 203454 (DNA19902-1669).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or about 43 to about 245, inclusive of FIG. 2 (SEQ ID NO:4), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1560 polypeptide having the sequence of amino acid residues from about 1 or about 43 to about 245, inclusive of FIG. 2 (SEQ ID NO:4), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1560 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 42 in the sequence of FIG. 2 (SEQ ID NO:4). The transmembrane domains have been tentatively identified as at about amino acid positions 19–42, 61–83, 92–114 and 209–230 in the PRO1560 amino acid sequence (FIG. 2, SEQ ID NO:4).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 43 to about 245, inclusive of FIG. 2 (SEQ ID NO:4), or (b) the complement of the DNA of (a).

Another embodiment is directed to fragments of a PRO1560 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1560 polypeptide encoded by any of the isolated nucleic acid sequences hereinabove defined.

In a specific aspect, the invention provides isolated native sequence PRO1560 polypeptide, which in one embodiment, includes an amino acid sequence comprising residues 1 or about 43 through 245 of FIG. 2 (SEQ ID NO:4).

In another aspect, the invention concerns an isolated PRO1560 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 43 to about 245, inclusive of FIG. 2 (SEQ ID NO:4).

In a further aspect, the invention concerns an isolated PRO1560 polypeptide, comprising an amino acid sequence scoring at least about 80% positives, preferably at least about 85% positives, more preferably at least about 90% positives, most preferably at least about 95% positives when compared with the amino acid sequence of residues 1 or about 43 through 245 of FIG. 2 (SEQ ID NO:4).

In yet another aspect, the invention concerns anisolated PRO1560 polypeptide, comprising the sequence of amino acid residues 1 or about 43 to about 245, inclusive of FIG. 2 (SEQ ID NO:4), or a fragment thereof sufficient to provide a binding site for an anti-PRO1560 antibody. Preferably, the PRO1560 fragment retains a qualitative biological activity of a native PRO1560 polypeptide.

In a still further aspect, the invention provides a polypeptide produced by (i) hybridizing a test DNA molecule under stringent conditions with (a) a DNA molecule encoding a PRO1560 polypeptide having the sequence of amino acid residues from about 1 or about 43 to about 245, inclusive of FIG. 2 (SEQ ID NO:4), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1560 polypeptide. In a particular embodiment, the agonist or antagonist is an anti-PRO1560 antibody.

In a further embodiment, the invention concerns a method of identifying agonists or antagonists of a native PRO1560 polypeptide, by contacting the native PRO1560 polypeptide with a candidate molecule and monitoring a biological activity mediated by said polypeptide.

In a still further embodiment, the invention concerns a composition comprising a PRO1560 polypeptide, or an agonist or antagonist as hereinabove defined, in combination with a pharmaceutically acceptable carrier.

2. PRO444

A cDNA clone (DNA26846-1393) has been identified that encodes a novel secreted polypeptide, designated in the present application as "PRO444."

In one embodiment, the invention provides an isolated nucleic acid molecule comprising DNA encoding a PRO444 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO444 polypeptide having the sequence of amino acid residues from about 1 or about 17 to about 117, inclusive of FIG. 4 (SEQ ID NO:6), or (b) the complement of the DNA molecule of (a).

In another aspect, the invention concerns an isolated nucleic acid molecule encoding a PRO444 polypeptide comprising DNA hybridizing to the complement of the nucleic acid between about residues 656 and about 958, inclusive, of FIG. 3 (SEQ ID NO:5). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203406 (DNA26846-1397), or (b) the complement of the DNA molecule of (a). In a preferred embodiment, the nucleic acid comprises a DNA encoding the same mature polypeptide encoded by the human protein cDNA in ATCC Deposit No. 203406 (DNA26846-1397).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 or about 17 to about 117, inclusive of FIG. 4 (SEQ ID NO:6), or the complement of the DNA of (a).

In a further aspect, the invention concerns an isolated nucleic acid molecule having at least about 10 nucleotides, more preferably at least about 20 nucleotides, and most preferably at least about 40 nucleotides and produced by hybridizing a test DNA molecule under stringent conditions with (a) a DNA molecule encoding a PRO444 polypeptide having the sequence of amino acid residues from about 1 or about 17 to about 117, inclusive of FIG. 4 (SEQ ID NO:6), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO444 polypeptide, with or without the N-terminal signal sequence and/or the initiating methionine, or is complementary to such encoding nucleic acid molecule. The signal peptide has been tentatively identified as extending from amino acid position 1 through about amino acid position 16 in the sequence of FIG. 4 (SEQ ID NO:6).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 17 to about 117, inclusive of FIG. 4 (SEQ ID NO:6), or (b) the complement of the DNA of (a).

Another embodiment is directed to fragments of a PRO444 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO444 polypeptide encoded by any of the isolated nucleic acid sequences hereinabove defined.

In a specific aspect, the invention provides isolated native sequence PRO444 polypeptide, which in one embodiment, includes an amino acid sequence comprising residues 1 or about 17 to 117 of FIG. 4 (SEQ ID NO:6).

In another aspect, the invention concerns an isolated PRO444 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 17 to about 117, inclusive of FIG. 4 (SEQ ID NO:6).

In a further aspect, the invention concerns an isolated PRO444 polypeptide, comprising an amino acid sequence scoring at least about 80% positives, preferably at least about 85% positives, more preferably at least about 90% positives, most preferably at least about 95% positives when compared with the amino acid sequence of residues 1 or about 17 to 117 of FIG. 4 (SEQ ID NO:6).

In yet another aspect, the invention concerns an isolated PRO444 polypeptide, comprising the sequence of amino acid residues 1 or about 17 to about 117, inclusive of FIG. 4 (SEQ ID NO:6), or a fragment thereof sufficient to provide a binding site for an anti-PRO444 antibody. Preferably, the PRO444 fragment retains a qualitative biological activity of a native PRO444 polypeptide.

In a still further aspect, the invention provides a polypeptide produced by (i) hybridizing a test DNA molecule under stringent conditions with (a) a DNA molecule encoding a PRO444 polypeptide having the sequence of amino acid residues from about 1 or about 17 to about 117, inclusive of FIG. 4 (SEQ ID NO:6), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

3. PRO1018

A cDNA clone (DNA56107-1415) has been identified that encodes a novel transmembrane polypeptide, designated in the present application as "PRO1018".

In one embodiment, the invention provides an isolated nucleic acid molecule comprising DNA encoding a PRO1018 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1018 polypeptide having the sequence of amino acid residues from about 1 or about 25 to about 189, inclusive of FIG. 6 (SEQ ID NO:8), or (b) the complement of the DNA molecule of (a).

In another aspect, the invention concerns an isolated nucleic acid molecule encoding a PRO1018 polypeptide comprising DNA hybridizing to the complement of the nucleic acid between about nucleotides 129 or about 201 and about 695, inclusive, of FIG. 5 (SEQ ID NO:7). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203405 (DNA56107-1415) or (b) the complement of the nucleic acid molecule of (a). In a preferred embodiment, the nucleic acid comprises a DNA encoding the same mature polypeptide encoded by the human protein cDNA in ATCC Deposit No. 203405 (DNA56107-1415).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 25 to about 189, inclusive of FIG. 62 (SEQ ID NO:8), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1018 polypeptide having the sequence of amino acid residues from 1 or about 25 to about 189, inclusive of FIG. 6 (SEQ ID NO:8), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1018 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 24 in the sequence of FIG. 6 (SEQ ID NO:8). The transmembrane domains have been tentatively identified as extending from about amino acid position 86 to about amino acid position 103 and from about amino acid position 60 to about amino acid position 75 in the PRO1018 amino acid sequence (FIG. 6, SEQ ID NO:8).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 25 to about 189, inclusive of FIG. 6 (SEQ ID NO:8), or (b) the complement of the DNA of (a).

Another embodiment is directed to fragments of a PRO1018 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 5 (SEQ ID NO:7).

In another embodiment, the invention provides isolated PRO1018 polypeptide encoded by any of the isolated nucleic acid sequences hereinabove identified.

In a specific aspect, the invention provides isolated native sequence PRO1018 polypeptide, which in certain embodiments, includes an amino acid sequence comprising residues 1 or about 25 to about 189 of FIG. 6 (SEQ ID NO:8).

In another aspect, the invention concerns an isolated PRO1018 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 25 to about 189, inclusive of FIG. 6 (SEQ ID NO:8).

In a further aspect, the invention concerns an isolated PRO1018 polypeptide, comprising an amino acid sequence scoring at least about 80% positives, preferably at least about 85% positives, more preferably at least about 90% positives, most preferably at least about 95% positives when compared with the amino acid sequence of residues 1 or about 25 to about 189, inclusive of FIG. 6 (SEQ ID NO:8).

In yet another aspect, the invention concerns an isolated PRO1018 polypeptide, comprising the sequence of amino acid residues 1 or about 25 to about 189, inclusive of FIG. 6 (SEQ ID NO:8), or a fragment thereof sufficient to provide a binding site for an anti-PRO1018 antibody. Preferably, the PRO1018 fragment retains a qualitative biological activity of a native PRO1018 polypeptide.

In a still further aspect, the invention provides a polypeptide produced by (i) hybridizing a test DNA molecule under stringent conditions with (a) a DNA molecule encoding a PRO1018 polypeptide having the sequence of amino acid residues from about 1 or about 25 to about 189, inclusive of FIG. 6 (SEQ ID NO:8), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

4. PRO1773

A cDNA clone (DNA56406-1704) has been identified, having homology to nucleic acid encoding a retinol dehydrogenase protein that encodes a novel polypeptide, designated in the present application as "PRO1773".

In one embodiment, the invention provides an isolated nucleic acid molecule comprising DNA encoding a PRO1773 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1773 polypeptide having the sequence of amino acid residues from about 1 or about 18 to about 319, inclusive of FIG. 8 (SEQ ID NO:10), or (b) the complement of the DNA molecule of (a).

In another aspect, the invention concerns an isolated nucleic acid molecule encoding a PRO1773 polypeptide comprising DNA hybridizing to the complement of the nucleic acid between about nucleotides 111 or about 162 and about 1067, inclusive, of FIG. 7 (SEQ ID NO:9). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203478 (DNA56406-1704) or (b) the complement of the nucleic acid molecule of (a). In a preferred embodiment, the nucleic acid comprises a DNA encoding the same mature polypeptide encoded by the human protein cDNA in ATCC Deposit No. 203478 (DNA56406-1704).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 18 to about 319, inclusive of FIG. 8 (SEQ ID NO:10), or (b) the complement of the DNA of (a).

In a further aspect, the invention concerns an isolated nucleic acid molecule having at least 525 nucleotides and produced by hybridizing a test DNA molecule under stringent conditions with (a) a DNA molecule encoding a PRO1773 polypeptide having the sequence of amino acid residues from 1 or about 18 to about 319, inclusive of FIG. 8 (SEQ ID NO:10), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1773 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 17 in the sequence of FIG. 8 (SEQ ID NO:10). The transmembrane domain has been tentatively identified as extending from about amino acid position 136 to about amino acid position 152 in the PRO1773 amino acid sequence (FIG. 8, SEQ ID NO:10).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 18 to about 319, inclusive of FIG. 8 (SEQ ID NO:10), or (b) the complement of the DNA of (a).

Another embodiment is directed to fragments of a PRO1773 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 7 (SEQ ID NO:9).

In another embodiment, the invention provides isolated PRO1773 polypeptide encoded by any of the isolated nucleic acid sequences hereinabove identified.

In a specific aspect, the invention provides isolated native sequence PRO1773 polypeptide, which in certain embodiments, includes an amino acid sequence comprising residues 1 or about 18 to about 319 of FIG. 8 (SEQ ID NO:10).

In another aspect, the invention concerns an isolated PRO1773 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 18 to about 319, inclusive of FIG. 8 (SEQ ID NO:10).

In a further aspect, the invention concerns an isolated PRO1773 polypeptide, comprising an amino acid sequence scoring at least about 80% positives, preferably at least about 85% positives, more preferably at least about 90% positives, most preferably at least about 95% positives when compared with the amino acid sequence of residues 1 or about 18 to about 319, inclusive of FIG. 8 (SEQ ID NO:10).

In yet another aspect, the invention concerns an isolated PRO1773 polypeptide, comprising the sequence of amino acid residues 1 or about 18 to about 319, inclusive of FIG. 8 (SEQ ID NO:10), or a fragment thereof sufficient to provide a binding site for an anti-PRO1773 antibody. Preferably, the PRO1773 fragment retains a qualitative biological activity of a native PRO1773 polypeptide.

In a still further aspect, the invention provides a polypeptide produced by (i) hybridizing a test DNA molecule under stringent conditions with (a) a DNA molecule encoding a PRO1773 polypeptide having the sequence of amino acid residues from about 1 or about 18 to about 319, inclusive of FIG. 8 (SEQ ID NO:10), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1773 polypeptide. In a particular embodiment, the agonist or antagonist is an anti-PRO1773 antibody.

In a further embodiment, the invention concerns a method of identifying agonists or antagonists of a native PRO1773 polypeptide by contacting the native PRO1773 polypeptide with a candidate molecule and monitoring a biological activity mediated by said polypeptide.

In a still further embodiment, the invention concerns a composition comprising a PRO1773 polypeptide, or an agonist or antagonist as hereinabove defined, in combination with a pharmaceutically acceptable carrier.

5. PRO1477

A cDNA clone (DNA56529-1647) has been identified, having homology to nucleic acid encoding a mannosidase protein that encodes a novel polypeptide, designated in the present application as "PRO1477".

In one embodiment, the invention provides an isolated nucleic acid molecule comprising DNA encoding a PRO1477 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1477 polypeptide having the sequence of amino acid residues from about 1 to about 699, inclusive of FIG. 10 (SEQ ID NO:12), or (b) the complement of the DNA molecule of (a).

In another aspect, the invention concerns an isolated nucleic acid molecule encoding a PRO1477 polypeptide comprising DNA hybridizing to the complement of the nucleic acid between about nucleotides 23 and about 2119, inclusive, of FIG. 9 (SEQ ID NO:11). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203293 (DNA56529-1647) or (b) the complement of the nucleic acid molecule of (a). In a preferred embodiment, the nucleic acid comprises a DNA encoding the same mature polypeptide encoded by the human protein cDNA in ATCC Deposit No. 203293 (DNA56529-1647).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 699, inclusive of FIG. 10 (SEQ ID NO:12), or (b) the complement of the DNA of (a).

In a further aspect, the invention concerns an isolated nucleic acid molecule having at least 540 nucleotides and produced by hybridizing a test DNA molecule under stringent conditions with (a) a DNA molecule encoding a PRO1477 polypeptide having the sequence of amino acid residues from 1 to about 699, inclusive of FIG. 10 (SEQ ID NO:12), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1477 polypeptide, with or without and/or the initiating methionine, and its soluble, i.e., transmembrane domain deleted or inactivated variants, or is complementary to such encoding nucleic acid molecule. The transmembrane domains have been tentatively identified as extending from about amino acid position 21 to about amino acid position 40 and from about amino acid position 84 to about amino acid position 105 in the PRO1477 amino acid sequence (FIG. 10, SEQ ID NO:12).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 699, inclusive of FIG. 10 (SEQ ID NO:12), or (b) the complement of the DNA of (a).

Another embodiment is directed to fragments of a PRO1477 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 9 (SEQ ID NO:11).

In another embodiment, the invention provides isolated PRO1477 polypeptide encoded by any of the isolated nucleic acid sequences hereinabove identified.

In a specific aspect, the invention provides isolated native sequence PRO1477 polypeptide, which in certain embodiments, includes an amino acid sequence comprising residues 1 to about 699 of FIG. 10 (SEQ ID NO:12).

In another aspect, the invention concerns an isolated PRO1477 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 699, inclusive of FIG. 10 (SEQ ID NO:12).

In a further aspect, the invention concerns an isolated PRO1477 polypeptide, comprising an amino acid sequence scoring at least about 80% positives, preferably at least about 85% positives, more preferably at least about 90% positives, most preferably at least about 95% positives when compared with the amino acid sequence of residues 1 to about 699, inclusive of FIG. 10 (SEQ ID NO:12).

In yet another aspect, the invention concerns an isolated PRO1477 polypeptide, comprising the sequence of amino acid residues 1 to about 699, inclusive of FIG. 10 (SEQ ID NO:12), or a fragment thereof sufficient to provide a binding site for an anti-PRO1477 antibody. Preferably, the PRO1477 fragment retains a qualitative biological activity of a native PRO1477 polypeptide.

In a still further aspect, the invention provides a polypeptide produced by (i) hybridizing a test DNA molecule under stringent conditions with (a) a DNA molecule encoding a PRO1477 polypeptide having the sequence of amino acid residues from about 1 to about 699, inclusive of FIG. 10 (SEQ ID NO:12), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1477 polypeptide. In a particular embodiment, the agonist or antagonist is an anti-PRO1477 antibody.

In a further embodiment, the invention concerns a method of identifying agonists or antagonists of a native PRO1477 polypeptide by contacting the native PRO1477 polypeptide with a candidate molecule and monitoring a biological activity mediated by said polypeptide.

In a still further embodiment, the invention concerns a composition comprising a PRO1477 polypeptide, or an agonist or antagonist as hereinabove defined, in combination with a pharmaceutically acceptable carrier.

6. PRO1478

A cDNA clone (DNA56531-1648) has been identified that encodes a novel polypeptide having sequence identity with galactosyltransferase and designated in the present application as "PRO1478."

In one embodiment, the invention provides an isolated nucleic acid molecule comprising DNA encoding a PRO1478 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1478 polypeptide having the sequence of amino acid residues from about 1 to about 327, inclusive of FIG. 12 (SEQ ID NO:17), or (b) the complement of the DNA molecule of (a).

In another aspect, the invention concerns an isolated nucleic acid molecule encoding a PRO1478 polypeptide comprising DNA hybridizing to the complement of the nucleic acid between about residues 77 and about 1057, inclusive, of FIG. 11 (SEQ ID NO:16). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203286 (DNA56531-1648), or (b) the complement of the DNA molecule of (a). In a preferred embodiment, the nucleic acid comprises a DNA encoding the same mature polypeptide encoded by the human protein cDNA in ATCC Deposit No. 203286 (DNA56531-1648).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 327, inclusive of FIG. 12 (SEQ ID NO:17), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1478 polypeptide having the sequence of amino acid residues from about 1 to about 327, inclusive of FIG. 12 (SEQ ID NO:17), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1478 polypeptide in its soluble form, i.e. transmembrane domain deleted or inactivated variants, or is complementary to such encoding nucleic acid molecule. The transmembrane domain (type II) has been tentatively identified as extending from about amino acid position 29 through about amino acid position 49 in the PRO1478 amino acid sequence (FIG. 12, SEQ ID NO:17). Therefore, a peptide including amino acids 50–327, with or without amino acids 1–28, is specifically embodied herein, as well as the nucleic acid encoding such a peptide.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 327, inclusive of FIG. 12 (SEQ ID NO:17), or (b) the complement of the DNA of (a).

Another embodiment is directed to fragments of a PRO1478 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1478 polypeptide encoded by any of the isolated nucleic acid sequences hereinabove defined.

In a specific aspect, the invention provides isolated native sequence PRO1478 polypeptide, which in one embodiment, includes an amino acid sequence comprising residues 1 through 327 of FIG. 12 (SEQ ID NO:17).

In another aspect, the invention concerns an isolated PRO1478 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 327, inclusive of FIG. 12 (SEQ ID NO:17).

In a further aspect, the invention concerns an isolated PRO1478 polypeptide, comprising an amino acid sequence scoring at least about 80% positives, preferably at least about 85% positives, more preferably at least about 90% positives, most preferably at least about 95% positives when compared with the amino acid sequence of residues 1 through 327 of FIG. 12 (SEQ ID NO:17).

In yet another aspect, the invention concerns an isolated PRO1478 polypeptide, comprising the sequence of amino acid residues 1 to about 327, inclusive of FIG. 12 (SEQ ID NO:17), or a fragment thereof sufficient to provide a binding site for an anti-PRO1478 antibody. Preferably, the PRO1478 fragment retains a qualitative biological activity of a native PRO1478 polypeptide.

In a still further aspect, the invention provides a polypeptide produced by (i) hybridizing a test DNA molecule under stringent conditions with (a) a DNA molecule encoding a PRO1478 polypeptide having the sequence of amino acid residues from about 1 to about 327, inclusive of FIG. 12 (SEQ ID NO:17), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1478 polypeptide. In a particular embodiment, the agonist or antagonist is an anti-PRO1478 antibody.

In a further embodiment, the invention concerns a method of identifying agonists or antagonists of a native PRO1478 polypeptide, by contacting the native PRO1478 polypeptide with a candidate molecule and monitoring a biological activity mediated by said polypeptide.

In a still further embodiment, the invention concerns a composition comprising a PRO1478 polypeptide, or an agonist or antagonist as hereinabove defined, in combination with a pharmaceutically acceptable carrier.

7. PRO831

A cDNA clone (DNA56862-1343) has been identified that encodes a novel secreted polypeptide, designated in the present application as "PRO831".

In one embodiment, the invention provides an isolated nucleic acid molecule comprising DNA encoding a PRO831 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO831 polypeptide having the sequence of amino acid residues from about 1 or about 16 to about 73, inclusive of FIG. 14 (SEQ ID NO:22), or (b) the complement of the DNA molecule of (a).

In another aspect, the invention concerns an isolated nucleic acid molecule encoding a PRO831 polypeptide comprising DNA hybridizing to the complement of the nucleic acid between about nucleotides 40 or about 85 and about 258, inclusive, of FIG. 13 (SEQ ID NO:21). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203174 (DNA56862-1343) or (b) the complement of the nucleic acid molecule of (a). In a preferred embodiment, the nucleic acid comprises a DNA encoding the same mature polypeptide encoded by the human protein cDNA in ATCC Deposit No. 203174 (DNA56862-1343).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 73, inclusive of FIG. 14 (SEQ ID NO:22), or (b) the complement of the DNA of (a).

In a further aspect, the invention concerns an isolated nucleic acid molecule having at least 470 nucleotides and produced by hybridizing a test DNA molecule under stringent conditions with (a) a DNA molecule encoding a PRO831 polypeptide having the sequence of amino acid residues from 1 or about 16 to about 73, inclusive of FIG. 14 (SEQ ID NO:22), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO831 polypeptide, with or without the N-terminal signal sequence and/or the initiating methionine, or is complementary to such encoding nucleic acid molecule. The signal peptide has been tentatively identified as extending from about amino acid position 1 to about amino acid position 15 in the sequence of FIG. 14 (SEQ ID NO:22).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 73, inclusive of FIG. 14 (SEQ ID NO:22), or (b) the complement of the DNA of (a).

Another embodiment is directed to fragments of a PRO831 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 13 (SEQ ID NO:21).

In another embodiment, the invention provides isolated PRO831 polypeptide encoded by any of the isolated nucleic acid sequences hereinabove identified.

In a specific aspect, the invention provides isolated native sequence PRO831 polypeptide, which in certain embodiments, includes an amino acid sequence comprising residues 1 or about 16 to about 73 of FIG. 14 (SEQ ID NO:22).

In another aspect, the invention concerns an isolated PRO831 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 73, inclusive of FIG. 14 (SEQ ID NO:22).

In a further aspect, the invention concerns an isolated PRO831 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 73, inclusive of FIG. 14 (SEQ ID NO:22).

In yet another aspect, the invention concerns an isolated PRO831 polypeptide, comprising the sequence of amino acid residues 1 or about 16 to about 73, inclusive of FIG. 14 (SEQ ID NO:22), or a fragment thereof sufficient to provide a binding site for an anti-PRO831 antibody. Preferably, the PRO831 fragment retains a qualitative biological activity of a native PRO831 polypeptide.

In a still further aspect, the invention provides a polypeptide produced by (i) hybridizing a test DNA molecule under stringent conditions with (a) a DNA molecule encoding a PRO831 polypeptide having the sequence of amino acid residues from about 1 or about 16 to about 73, inclusive of FIG. 14 (SEQ ID NO:22), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

8. PRO1113

A cDNA clone (DNA57254-1477) has been identified that encodes a novel polypeptide having sequence identity with leucine rich repeat proteins and designated in the present application as "PRO1113."

In one embodiment, the invention provides an isolated nucleic acid molecule comprising DNA encoding a PRO1113 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1113 polypeptide having the sequence of amino acid residues from about 1 to about 616, inclusive of FIG. 16 (SEQ ID NO:24), or (b) the complement of the DNA molecule of (a).

In another aspect, the invention concerns an isolated nucleic acid molecule encoding a PRO1113 polypeptide comprising DNA hybridizing to the complement of the nucleic acid between about residues 214 and about 2061, inclusive, of FIG. 15 (SEQ ID NO:23). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203289 (DNA57254-1477), or (b) the complement of the DNA molecule of (a). In a preferred embodiment, the nucleic acid comprises a DNA encoding the same mature polypeptide encoded by the human protein cDNA in ATCC Deposit No. 203289 (DNA57254-1477).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 616, inclusive of FIG. 16 (SEQ ID NO:24), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1113 polypeptide having the sequence of amino acid residues from about 1 to about 616, inclusive of FIG. 16 (SEQ ID NO:24), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1113 polypeptide in its soluble, i.e. transmembrane domain deleted or inactivated variants, or is complementary to such encoding nucleic acid molecule. The transmembrane domain has been tentatively identified as extending from about amino acid position 13 through about amino acid position 40 in the PRO1113 amino acid sequence (FIG. 16, SEQ ID NO:24). Thus, also presented herein is a peptide comprising amino acids 41–616, and optionally 1–12 of SEQ ID NO:24, and the nucleic acids encoding the same.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 616, inclusive of FIG. 16 (SEQ ID NO:24), or (b) the complement of the DNA of (a).

Another embodiment is directed to fragments of a PRO1113 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO113 polypeptide encoded by any of the isolated nucleic acid sequences hereinabove defined.

In a specific aspect, the invention provides isolated native sequence PRO1113 polypeptide, which in one embodiment, includes an amino acid sequence comprising residues 1 through 616 of FIG. 16 (SEQ ID NO:24).

In another aspect, the invention concerns an isolated PRO113 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 616, inclusive of FIG. 16 (SEQ ID NO:24).

In a further aspect, the invention concerns an isolated PRO1113 polypeptide, comprising an amino acid sequence scoring at least about 80% positives, preferably at least about 85% positives, more preferably at least about 90% positives, most preferably at least about 95% positives when compared with the amino acid sequence of residues 1 through 616 of FIG. 16 (SEQ ID NO:24).

In yet another aspect, the invention concerns anisolated PRO113 polypeptide, comprising the sequence of amino acid residues 1 to about 616, inclusive of FIG. 16 (SEQ ID NO:24), or a fragment thereof sufficient to provide a binding site for an anti-PRO1113 antibody. Preferably, the PRO1113 fragment retains a qualitative biological activity of a native PRO1113 polypeptide.

In a still further aspect, the invention provides a polypeptide produced by (i) hybridizing a test DNA molecule under stringent conditions with (a) a DNA molecule encoding a PRO1113 polypeptide having the sequence of amino acid residues from about 1 to about 616, inclusive of FIG. 16 (SEQ ID NO:24), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1113 polypeptide. In a particular embodiment, the agonist or antagonist is an anti-PRO113 antibody.

In a further embodiment, the invention concerns a method of identifying agonists or antagonists of a native PRO1113 polypeptide, by contacting the native PRO1113 polypeptide with a candidate molecule and monitoring a biological activity mediated by said polypeptide.

In a still further embodiment, the invention concerns a composition comprising a PRO1113 polypeptide, or an agonist or antagonist as hereinabove defined, in combination with a pharmaceutically acceptable carrier.

9. PRO1194

A cDNA clone (DNA57841-1522) has been identified that encodes a novel secreted polypeptide designated in the present application as "PRO1194."

In one embodiment, the invention provides an isolated nucleic acid molecule comprising DNA encoding a PRO1194 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1194 polypeptide having the sequence of amino acid residues from 1 or about 22 to about 81, inclusive of FIG. 18 (SEQ ID NO:29), or (b) the complement of the DNA molecule of (a).

In another aspect, the invention concerns an isolated nucleic acid molecule encoding a PRO1194 polypeptide comprising DNA hybridizing to the complement of the nucleic acid between about residues 72 and about 251, inclusive, of FIG. 17 (SEQ ID NO:28). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203458 (DNA57841-1522), or (b) the complement of the DNA molecule of (a). In a preferred embodiment, the nucleic acid comprises a DNA encoding the same mature polypeptide encoded by the human protein cDNA in ATCC Deposit No. 203458 (DNA57841-1522).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 22 to about 81, inclusive of FIG. 18 (SEQ ID NO:29), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1194 polypeptide having the sequence of amino acid residues from about 22 to about 81, inclusive of FIG. 18 (SEQ ID NO:29), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 22 to about 81, inclusive of FIG. 18 (SEQ ID NO:29), or (b) the complement of the DNA of (a).

Another embodiment is directed to fragments of a PRO1194 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1194 polypeptide encoded by any of the isolated nucleic acid sequences hereinabove defined.

In a specific aspect, the invention provides isolated native sequence PRO1194 polypeptide, which in one embodiment, includes an amino acid sequence comprising residues 22 through 81 of FIG. 18 (SEQ ID NO:29).

In another aspect, the invention concerns an isolated PRO1194 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 22 to about 81, inclusive of FIG. 18 (SEQ ID NO:29).

In a further aspect, the invention concerns an isolated PRO1194 polypeptide, comprising an amino acid sequence scoring at least about 80% positives, preferably at least about 85% positives, more preferably at least about 90% positives, most preferably at least about 95% positives when compared with the amino acid sequence of residues 22 through 81 of FIG. 18 (SEQ ID NO:29).

In yet another aspect, the invention concerns an isolated PRO1194 polypeptide, comprising the sequence of amino acid residues 22 to about 81, inclusive of FIG. 18 (SEQ ID NO:29), or a fragment thereof sufficient to provide a binding site for an anti-PRO1194 antibody. Preferably, the PRO1194 fragment retains a qualitative biological activity of a native PRO1194 polypeptide.

In a still further aspect, the invention provides a polypeptide produced by (i) hybridizing a test DNA molecule under stringent conditions with (a) a DNA molecule encoding a PRO1194 polypeptide having the sequence of amino acid residues from about 22 to about 81, inclusive of FIG. 18 (SEQ ID NO:29), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1194 polypeptide. In a particular embodiment, the agonist or antagonist is an anti-PRO1194 antibody.

In a further embodiment, the invention concerns a method of identifying agonists or antagonists of a native PRO1194 polypeptide, by contacting the native PRO1194 polypeptide with a candidate molecule and monitoring a biological activity mediated by said polypeptide.

In a still further embodiment, the invention concerns a composition comprising a PRO1194 polypeptide, or an agonist or antagonist as hereinabove defined, in combination with a pharmaceutically acceptable carrier.

10. PRO1110

A cDNA clone (DNA58727-1474) has been identified, having homology to nucleic acid encoding myeloid upregulated protein that encodes a novel polypeptide, designated in the present application as "PRO1110".

In one embodiment, the invention provides an isolated nucleic acid molecule comprising DNA encoding a PRO1110 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1110 polypeptide having the sequence of amino acid residues from about 1 to about 322, inclusive of FIG. 20 (SEQ ID NO:31), or (b) the complement of the DNA molecule of (a).

In another aspect, the invention concerns an isolated nucleic acid molecule encoding a PRO1110 polypeptide comprising DNA hybridizing to the complement of the nucleic acid between about nucleotides 131 and about 1096, inclusive, of FIG. 19 (SEQ ID NO:30). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203171 (DNA58727-1474) or (b) the complement of the nucleic acid molecule of (a). In a preferred embodiment, the nucleic acid comprises a DNA encoding the same mature polypeptide encoded by the human protein cDNA in ATCC Deposit No. 203171 (DNA58727-1474).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 322, inclusive of FIG. 20 (SEQ ID NO:31), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1110 polypeptide having the sequence of amino acid residues from 1 to about 322, inclusive of FIG. 20 (SEQ ID NO:31), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1110 polypeptide, with or without the initiating methionine and its soluble, i.e., transmembrane domain deleted or inactivated variants, or is complementary to such encoding nucleic acid molecule. The transmembrane domains have been tentatively identified as extending from about amino acid position 41 to about amino acid position 60, from about amino acid position 66 to about amino acid position 85, from about amino acid position 101 to about amino acid position 120, from about amino acid position 137 to about amino acid position 153, from about amino acid position 171 to about amino acid position 192, from about amino acid position 205 to about amino acid position 226, from about amino acid position 235 to about amino acid position 255, and from about amino acid position 294 to about amino acid position 312 in the PRO110 amino acid sequence (FIG. 20, SEQ ID NO:31).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 322, inclusive of FIG. 20 (SEQ ID NO:31), or (b) the complement of the DNA of (a).

Another embodiment is directed to fragments of a PRO1110 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 19 (SEQ ID NO:30).

In another embodiment, the invention provides isolated PRO1110 polypeptide encoded by any of the isolated nucleic acid sequences hereinabove identified.

In a specific aspect, the invention provides isolated native sequence PRO1110 polypeptide, which in certain embodiments, includes an amino acid sequence comprising residues 1 to about 322 of FIG. 20 (SEQ ID NO:31).

In another aspect, the invention concerns an isolated PRO1110 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 322, inclusive of FIG. 20 (SEQ ID NO:31).

In a further aspect, the invention concerns an isolated PRO1110 polypeptide, comprising an amino acid sequence scoring at least about 80% positives, preferably at least about 85% positives, more preferably at least about 90% positives, most preferably at least about 95% positives when compared with the amino acid sequence of residues 1 to about 322, inclusive of FIG. 20 (SEQ ID NO:31).

In yet another aspect, the invention concerns an isolated PRO1110 polypeptide, comprising the sequence of amino acid residues 1 to about 322, inclusive of FIG. 20 (SEQ ID NO:31), or a fragment thereof sufficient to provide a binding site for an anti-PRO1110 antibody. Preferably, the PRO1110 fragment retains a qualitative biological activity of a native PRO110 polypeptide.

In a still further aspect, the invention provides a polypeptide produced by (i) hybridizing a test DNA molecule under stringent conditions with (a) a DNA molecule encoding a PRO110 polypeptide having the sequence of amino acid residues from about 1 to about 322, inclusive of FIG. 20 (SEQ ID NO:31), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1110 polypeptide. In a particular embodiment, the agonist or antagonist is an anti-PRO1110 antibody.

In a further embodiment, the invention concerns a method of identifying agonists or antagonists of a native PRO1110 polypeptide by contacting the native PRO1110 polypeptide with a candidate molecule and monitoring a biological activity mediated by said polypeptide.

In a still further embodiment, the invention concerns a composition comprising a PRO1110 polypeptide, or an agonist or antagonist as hereinabove defined, in combination with a pharmaceutically acceptable carrier.

11. PRO1378

A cDNA clone (DNA58730-1607) has been identified that encodes a novel secreted polypeptide designated in the present application as "PRO1378".

In one embodiment, the invention provides an isolated nucleic acid molecule comprising DNA encoding a PRO1378 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1378 polypeptide having the sequence of amino acid residues from 1 or about 16 to about 335, inclusive of FIG. 22 (SEQ ID NO:33), or (b) the complement of the DNA molecule of (a).

In another aspect, the invention concerns an isolated nucleic acid molecule encoding a PRO1378 polypeptide comprising DNA hybridizing to the complement of the nucleic acid between about residues 1365 and about 2369, inclusive, of FIG. 21 (SEQ ID NO:32). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203221 (DNA58730-1607), or (b) the complement of the DNA molecule of (a). In a preferred embodiment, the nucleic acid comprises a DNA encoding the same mature polypeptide encoded by the human protein cDNA in ATCC Deposit No. 203221 (DNA58730-1607).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from 1 or about 16 to about 335, inclusive of FIG. 22 (SEQ ID NO:33), or the complement of the DNA of (a).

In a further aspect, the invention concerns an isolated nucleic acid molecule having at least about 20 nucleotides, preferably at least about 50 nucleotides, and more preferably at least about 100 nucleotides and produced by hybridizing a test DNA molecule under stringent conditions with (a) a DNA molecule encoding a PRO1378 polypeptide having the sequence of amino acid residues from about 16 to about 335, inclusive of FIG. 22 (SEQ ID NO:33), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1378 polypeptide, with or without the N-terminal signal sequence, or is complementary to such encoding nucleic acid molecule. The signal peptide has been tentatively identified as extending from amino acid position 1 through about amino acid position 15 in the sequence of FIG. 22 (SEQ ID NO:33).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 16 to about 335, inclusive of FIG. 22 (SEQ ID NO:33), or (b) the complement of the DNA of (a).

Another embodiment is directed to fragments of a PRO1378 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1378 polypeptide encoded by any of the isolated nucleic acid sequences hereinabove defined.

In a specific aspect, the invention provides isolated native sequence PRO1378 polypeptide, which in one embodiment, includes an amino acid sequence comprising residues 16 to 335 of FIG. 22 (SEQ ID NO:33).

In another aspect, the invention concerns an isolated PRO1378 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 16 to about 335, inclusive of FIG. 22 (SEQ ID NO:33).

In a further aspect, the invention concerns an isolated PRO1378 polypeptide, comprising an amino acid sequence scoring at least about 80% positives, preferably at least about 85% positives, more preferably at least about 90% positives, most preferably at least about 95% positives when compared with the amino acid sequence of residues 16 to 335 of FIG. 22 (SEQ ID NO:33).

In yet another aspect, the invention concerns an isolated PRO1378 polypeptide, comprising the sequence of amino acid residues 16 to about 335, inclusive of FIG. 22 (SEQ ID NO:33), or a fragment thereof sufficient to provide a binding site for an anti-PRO1378 antibody. Preferably, the PRO1378 fragment retains a qualitative biological activity of a native PRO1378 polypeptide.

In a still further aspect, the invention provides a polypeptide produced by (i) hybridizing a test DNA molecule under stringent conditions with (a) a DNA molecule encoding a PRO1378 polypeptide having the sequence of amino acid residues from about 16 to about 335, inclusive of FIG. 22 (SEQ ID NO:33), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

12. PRO1481

A cDNA clone (DNA58732-1650) has been identified that encodes a novel polypeptide designated in the present application as "PRO1481."

In one embodiment, the invention provides an isolated nucleic acid molecule comprising DNA encoding a PRO1481 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1481 polypeptide having the sequence of amino acid residues from 1 or about 24 to about 334, inclusive of FIG. 24 (SEQ ID NO:41), or (b) the complement of the DNA molecule of (a).

In another aspect, the invention concerns an isolated nucleic acid molecule encoding a PRO1481 polypeptide comprising DNA hybridizing to the complement of the nucleic acid between about residues 88 and about 1321, inclusive, of FIG. 23 (SEQ ID NO:40). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203290 (DNA58732-1650), or (b) the complement of the DNA molecule of (a). In a preferred embodiment, the nucleic acid comprises a DNA encoding the same mature polypeptide encoded by the human protein cDNA in ATCC Deposit No. 203290 (DNA58732-1650).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 24 to about 334, inclusive of FIG. 24 (SEQ ID NO:41), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1481 polypeptide having the sequence of amino acid residues from about 24 to about 334, inclusive of FIG. 24 (SEQ ID NO:41), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1481 polypeptide, with or without the N-terminal signal sequence and/or the initiating methionine, and its soluble, i.e. transmembrane domain deleted, truncated or inactivated variants, or is complementary to such encoding nucleic acid molecule. The signal peptide has been tentatively identified as extending from amino acid position 1 through about amino acid position 23 in the sequence of FIG. 24 (SEQ ID NO:41). The transmembrane domain has been tentatively identified as extending from about amino acid position 235 through about amino acid position 262 in the PRO1481 amino acid sequence (FIG. 24, SEQ ID NO:41).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 24 to about 334, inclusive of FIG. 24 (SEQ ID NO:41), or (b) the complement of the DNA of (a).

Another embodiment is directed to fragments of a PRO1481 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1481 polypeptide encoded by any of the isolated nucleic acid sequences hereinabove defined.

In a specific aspect, the invention provides isolated native sequence PRO1481 polypeptide, which in one embodiment, includes an amino acid sequence comprising residues 24 through 334 of FIG. 24 (SEQ ID NO:41).

In another aspect, the invention concerns an isolated PRO1481 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 24 to about 334, inclusive of FIG. 24 (SEQ ID NO:41).

In a further aspect, the invention concerns an isolated PRO1481 polypeptide, comprising an amino acid sequence scoring at least about 80% positives, preferably at least about 85% positives, more preferably at least about 90% positives, most preferably at least about 95% positives when compared with the amino acid sequence of residues 24 through 334 of FIG. 24 (SEQ ID NO:41).

In yet another aspect, the invention concerns an isolated PRO1481 polypeptide, comprising the sequence of amino acid residues 24 to about 334, inclusive of FIG. 24 (SEQ ID NO:41), or a fragment thereof sufficient to provide a binding site for an anti-PRO1481 antibody. Preferably, the PRO1481 fragment retains a qualitative biological activity of a native PRO1481 polypeptide.

In a still further aspect, the invention provides a polypeptide produced by (i) hybridizing a test DNA molecule under stringent conditions with (a) a DNA molecule encoding a PRO1481 polypeptide having the sequence of amino acid residues from about 24 to about 334, inclusive of FIG. 24 (SEQ ID NO:41), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1481 polypeptide. In a particular embodiment, the agonist or antagonist is an anti-PRO1481 antibody.

In a further embodiment, the invention concerns a method of identifying agonists or antagonists of a native PRO1481 polypeptide, by contacting the native PRO1481 polypeptide with a candidate molecule and monitoring a biological activity mediated by said polypeptide.

In a still further embodiment, the invention concerns a composition comprising a PRO1481 polypeptide, or an agonist or antagonist as hereinabove defined, in combination with a pharmaceutically acceptable carrier.

13. PRO1189

A cDNA clone (DNA58828-1519) has been identified that encodes a novel polypeptide having homology to E25 which is designated in the present application as "PRO1189."

In one embodiment, the invention provides an isolated nucleic acid molecule comprising DNA encoding a PRO1189 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1189 polypeptide having the sequence of amino acid residues from about 1 to about 263, inclusive of FIG. 26 (SEQ ID NO:43), or (b) the complement of the DNA molecule of (a).

In another aspect, the invention concerns an isolated nucleic acid molecule encoding a PRO1189 polypeptide comprising DNA hybridizing to the complement of the nucleic acid between about residues 79 and about 867, inclusive, of FIG. 25 (SEQ ID NO:42). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203172 (DNA58828-1519), or (b) the complement of the DNA molecule of (a). In a preferred embodiment, the nucleic acid comprises a DNA encoding the same mature polypeptide encoded by the human protein cDNA in ATCC Deposit No. 203172 (DNA58828-1519).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 263, inclusive of FIG. 26 (SEQ ID NO:43), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1189 polypeptide having the sequence of amino acid residues from about 1 to about 263, inclusive of FIG. 26 (SEQ ID NO:43), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1189 polypeptide with its transmembrane domain deleted or inactivated, or is complementary to such encoding nucleic acid molecule. The transmembrane domain has been tentatively identified as extending from about amino acid position 53 through about amino acid position 75 in the PRO1189 amino acid sequence (FIG. 26, SEQ ID NO:43).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 263, inclusive of FIG. 26 (SEQ ID NO:43), or (b) the complement of the DNA of (a).

Another embodiment is directed to fragments of a PRO1189 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1189 polypeptide encoded by any of the isolated nucleic acid sequences hereinabove defined.

In a specific aspect, the invention provides isolated native sequence PRO1189 polypeptide, which in one embodiment, includes an amino acid sequence comprising residues 1 to 263 of FIG. 26 (SEQ ID NO:43).

In another aspect, the invention concerns an isolated PRO1189 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 263, inclusive of FIG. 26 (SEQ ID NO:43).

In a further aspect, the invention concerns an isolated PRO1189 polypeptide, comprising an amino acid sequence scoring at least about 80% positives, preferably at least about 85% positives, more preferably at least about 90% positives, most preferably at least about 95% positives when compared with the amino acid sequence of residues 1 to 263 of FIG. 26 (SEQ ID NO:43).

In yet another aspect, the invention concerns an isolated PRO1189 polypeptide, comprising the sequence of amino acid residues 1 to about 263, inclusive of FIG. 26 (SEQ ID NO:43), or a fragment thereof sufficient to provide a binding site for an anti-PRO1189 antibody. Preferably, the PRO1189 fragment retains a qualitative biological activity of a native PRO1189 polypeptide.

In a still further aspect, the invention provides a polypeptide produced by (i) hybridizing a test DNA molecule under stringent conditions with (a) a DNA molecule encoding a PRO1189 polypeptide having the sequence of amino acid residues from about 1 to about 263, inclusive of FIG. 26 (SEQ ID NO:43), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1189 polypeptide. In a particular embodiment, the agonist or antagonist is an anti-PRO1189 antibody.

In a further embodiment, the invention concerns a method of identifying agonists or antagonists of a native PRO1189 polypeptide, by contacting the native PRO1189 polypeptide with a candidate molecule and monitoring a biological activity mediated by said polypeptide.

In a still further embodiment, the invention concerns a composition comprising a PRO1189polypeptide, or an agonist or antagonist as hereinabove defined, in combination with a pharmaceutically acceptable carrier.

14. PRO1415

A cDNA clone (DNA58852-1637) has been identified that encodes a novel polypeptide, designated in the present application as "PRO1415".

In one embodiment, the invention provides an isolated nucleic acid molecule comprising DNA encoding a PRO1415 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1415 polypeptide having the sequence of amino acid residues from about 1 or about 26 to about 283, inclusive of FIG. 28 (SEQ ID NO:50), or (b) the complement of the DNA molecule of (a).

In another aspect, the invention concerns an isolated nucleic acid molecule encoding a PRO1415 polypeptide comprising DNA hybridizing to the complement of the nucleic acid between about nucleotides 148 or about 223 and about 996, inclusive, of FIG. 27 (SEQ ID NO:49). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203271 (DNA58852-1637) or (b) the complement of the nucleic acid molecule of (a). In a preferred embodiment, the nucleic acid comprises a DNA encoding the same mature polypeptide encoded by the human protein cDNA in ATCC Deposit No. 203271 (DNA58852-1637).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 283, inclusive of FIG. 28 (SEQ ID NO:50), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1415 polypeptide having the sequence of amino acid residues from 1 or about 26 to about 283, inclusive of FIG. 28 (SEQ ID NO:50), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1415 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 25 in the sequence of FIG. 28 (SEQ ID NO:50). The transmembrane domain has been tentatively identified as extending from about amino acid position 94 to about amino acid position 118 in the PRO1415 amino acid sequence (FIG. 28, SEQ ID NO:50).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 283, inclusive of FIG. 28 (SEQ ID NO:50), or (b) the complement of the DNA of (a).

Another embodiment is directed to fragments of a PRO1415 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 27 (SEQ ID NO:49).

In another embodiment, the invention provides isolated PRO1415 polypeptide encoded by any of the isolated nucleic acid sequences hereinabove identified.

In a specific aspect, the invention provides isolated native sequence PRO1415 polypeptide, which in certain embodiments, includes an amino acid sequence comprising residues 1 or about 26 to about 283 of FIG. 28 (SEQ ID NO:50).

In another aspect, the invention concerns an isolated PRO1415 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 283, inclusive of FIG. 28 (SEQ ID NO:50).

In a further aspect, the invention concerns an isolated PRO1415 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 283, inclusive of FIG. 28 (SEQ ID NO:50).

In yet another aspect, the invention concerns an isolated PRO1415 polypeptide, comprising the sequence of amino acid residues 1 or about 26 to about 283, inclusive of FIG. 28 (SEQ ID NO:50), or a fragment thereof sufficient to provide a binding site for an anti-PRO1415 antibody. Preferably, the PRO1415 fragment retains a qualitative biological activity of a native PRO1415 polypeptide.

In a still further aspect, the invention provides a polypeptide produced by (i) hybridizing a test DNA molecule under stringent conditions with (a) a DNA molecule encoding a PRO1415 polypeptide having the sequence of amino acid residues from about 1 or about 26 to about 283, inclusive of FIG. 28 (SEQ ID NO:50), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1415 polypeptide. In a particular embodiment, the agonist or antagonist is an anti-PRO1415 antibody.

In a further embodiment, the invention concerns a method of identifying agonists or antagonists of a native PRO1415 polypeptide by contacting the native PRO1415 polypeptide with a candidate molecule and monitoring a biological activity mediated by said polypeptide.

In a still further embodiment, the invention concerns a composition comprising a PRO1415 polypeptide, or an agonist or antagonist as hereinabove defined, in combination with a pharmaceutically acceptable carrier.

15. PRO1411

A cDNA clone (DNA59212-1627) has been identified that encodes a novel secreted polypeptide designated in the present application as "PRO1411."

In one embodiment, the invention provides an isolated nucleic acid molecule comprising DNA encoding a PRO1411 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1411 polypeptide having the sequence of amino acid residues from 1 or about 22 to about 440, inclusive of FIG. 30 (SEQ ID NO:52), or (b) the complement of the DNA molecule of (a).

In another aspect, the invention concerns an isolated nucleic acid molecule encoding a PRO1411 polypeptide comprising DNA hybridizing to the complement of the nucleic acid between about residues 247 and about 1503, inclusive, of FIG. 29 (SEQ ID NO:51). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203245 (DNA59212-1627), or (b) the complement of the DNA molecule of (a). In a preferred embodiment, the nucleic acid comprises a DNA encoding the same mature polypeptide encoded by the human protein cDNA in ATCC Deposit No. 203245 (DNA59212-1627).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 22 to about 440, inclusive of FIG. 30 (SEQ ID NO:52), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1411 polypeptide having the sequence of amino acid residues from about 22 to about 440, inclusive of FIG. 30 (SEQ ID NO:52), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 22 to about 440, inclusive of FIG. 30 (SEQ ID NO:52), or (b) the complement of the DNA of (a).

Another embodiment is directed to fragments of a PRO1411 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1411 polypeptide encoded by any of the isolated nucleic acid sequences hereinabove defined.

In a specific aspect, the invention provides isolated native sequence PRO1411 polypeptide, which in one embodiment, includes an amino acid sequence comprising residues 22 through 440 of FIG. 30 (SEQ ID NO:52).

In another aspect, the invention concerns an isolated PRO1411 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 22 to about 440, inclusive of FIG. 30 (SEQ ID NO:52).

In a further aspect, the invention concerns an isolated PRO1411 polypeptide, comprising an amino acid sequence scoring at least about 80% positives, preferably at least about 85% positives, more preferably at least about 90% positives, most preferably at least about 95% positives when compared with the amino acid sequence of residues 22 through 440 of FIG. 30 (SEQ ID NO:52).

In yet another aspect, the invention concerns an isolated PRO1411 polypeptide, comprising the sequence of amino acid residues 22 to about 440, inclusive of FIG. 30 (SEQ ID NO:52), or a fragment thereof sufficient to provide a binding site for an anti-PRO1411 antibody. Preferably, the PRO1411 fragment retains a qualitative biological activity of a native PRO1411 polypeptide.

In a still further aspect, the invention provides a polypeptide produced by (i) hybridizing a test DNA molecule under stringent conditions with (a) a DNA molecule encoding a PRO1411 polypeptide having the sequence of amino acid residues from about 22 to about 440, inclusive of FIG. 30 (SEQ ID NO:52), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1411 polypeptide. In a particular embodiment, the agonist or antagonist is an anti-PRO1411 antibody.

In a further embodiment, the invention concerns a method of identifying agonists or antagonists of a native PRO1411 polypeptide, by contacting the native PRO1411 polypeptide with a candidate molecule and monitoring a biological activity mediated by said polypeptide.

In a still further embodiment, the invention concerns a composition comprising a PRO1411 polypeptide, or an agonist or antagonist as hereinabove defined, in combination with a pharmaceutically acceptable carrier.

16. PRO1295

A cDNA clone (DNA59218-1559) has been identified that encodes a novel secreted polypeptide designated in the present application as "PRO1295."

In one embodiment, the invention provides an isolated nucleic acid molecule comprising DNA encoding a PRO1295 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1295 polypeptide having the sequence of amino acid residues from 1 or about 19 to about 280, inclusive of FIG. 32 (SEQ ID NO:54), or (b) the complement of the DNA molecule of (a).

In another aspect, the invention concerns an isolated nucleic acid molecule encoding a PRO1295 polypeptide comprising DNA hybridizing to the complement of the nucleic acid between about residues 261 and about 1046, inclusive, of FIG. 31 (SEQ ID NO:53). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203287 (DNA59218-1559), or (b) the complement of the DNA molecule of (a). In a preferred embodiment, the nucleic acid comprises a DNA encoding the same mature polypeptide encoded by the human protein cDNA in ATCC Deposit No. 203287 (DNA59218-1559).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 280, inclusive of FIG. 32 (SEQ ID NO:54), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1295 polypeptide having the sequence of amino acid residues from about 19 to about 280, inclusive of FIG. 32 (SEQ ID NO:54), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 280, inclusive of FIG. 32 (SEQ ID NO:54), or (b) the complement of the DNA of (a).

Another embodiment is directed to fragments of a PRO1295 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1295 polypeptide encoded by any of the isolated nucleic acid sequences hereinabove defined.

In a specific aspect, the invention provides isolated native sequence PRO1295 polypeptide, which in one embodiment, includes an amino acid sequence comprising residues 19 through 280 of FIG. 32 (SEQ ID NO:54).

In another aspect, the invention concerns an isolated PRO1295 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 280, inclusive of FIG. 32 (SEQ ID NO:54).

In a further aspect, the invention concerns an isolated PRO1295 polypeptide, comprising an amino acid sequence scoring at least about 80% positives, preferably at least about 85% positives, more preferably at least about 90% positives, most preferably at least about 95% positives when compared with the amino acid sequence of residues 19 through 280 of FIG. 32 (SEQ ID NO:54).

In yet another aspect, the invention concerns an isolated PRO1295 polypeptide, comprising the sequence of amino acid residues 19 to about 280, inclusive of FIG. 32 (SEQ ID NO:54), or a fragment thereof sufficient to provide a binding site for an anti-PRO1295 antibody. Preferably, the PRO1295 fragment retains a qualitative biological activity of a native PRO1295 polypeptide.

In a still further aspect, the invention provides a polypeptide produced by (i) hybridizing a test DNA molecule under stringent conditions with (a) a DNA molecule encoding a PRO1295 polypeptide having the sequence of amino acid residues from about 19 to about 280, inclusive of FIG. 32 (SEQ ID NO:54), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1295 polypeptide. In a particular embodiment, the agonist or antagonist is an anti-PRO1295 antibody.

In a further embodiment, the invention concerns a method of identifying agonists or antagonists of a native PRO1295 polypeptide, by contacting the native PRO1295 polypeptide with a candidate molecule and monitoring a biological activity mediated by said polypeptide.

In a still further embodiment, the invention concerns a composition comprising a PRO1295 polypeptide, or an agonist or antagonist as hereinabove defined, in combination with a pharmaceutically acceptable carrier.

17. PRO1359

A cDNA clone (DNA59219-1613) has been identified that encodes a novel polypeptide having sequence identity with sialytransferases and designated in the present application as "PRO1359" polypeptides.

In one embodiment, the invention provides an isolated nucleic acid molecule comprising DNA encoding a PRO1359 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1359 polypeptide having the sequence of amino acid residues from 1 or about 32 to about 299, inclusive of FIG. 34 (SEQ ID NO:56), or (b) the complement of the DNA molecule of (a).

In another aspect, the invention concerns an isolated nucleic acid molecule encoding a PRO1359 polypeptide comprising DNA hybridizing to the complement of the nucleic acid between about residues 277 and about 1080, inclusive, of FIG. 33 (SEQ ID NO:55). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203220 (DNA59219-1613), or (b) the complement of the DNA molecule of (a). In a preferred embodiment, the nucleic acid comprises a DNA encoding the same mature polypeptide encoded by the human protein cDNA in ATCC Deposit No. 203220 (DNA59219-1613).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 32 to about 299, inclusive of FIG. 34 (SEQ ID NO:56), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1359 polypeptide having the sequence of amino acid residues from about 32 to about 299, inclusive of FIG. 34 (SEQ ID NO:56), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1359 polypeptide in its soluble, i.e. transmembrane domain deleted or inactivated variants, or is complementary to such encoding nucleic acid molecule. The transmembrane domain (type IU) has been tentatively identified as extending from about amino acid position 9 through about amino acid position 31 in the PRO1359 amino acid sequence (FIG. 34, SEQ ID NO:56).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 32 to about 299, inclusive of FIG. 34 (SEQ ID NO:56), or (b) the complement of the DNA of (a).

Another embodiment is directed to fragments of a PRO1359 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1359 polypeptide encoded by any of the isolated nucleic acid sequences hereinabove defined.

In a specific aspect, the invention provides isolated native sequence PRO1359 polypeptide, which in one embodiment, includes an amino acid sequence comprising residues 32 through 299 of FIG. 34 (SEQ ID NO:56).

In another aspect, the invention concerns an isolated PRO1359 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 32 to about 299, inclusive of FIG. 34 (SEQ ID NO:56).

In a further aspect, the invention concerns an isolated PRO1359 polypeptide, comprising an amino acid sequence scoring at least about 80% positives, preferably at least about 85% positives, more preferably at least about 90% positives, most preferably at least about 95% positives when compared with the amino acid sequence of residues 32 through 299 of FIG. 34 (SEQ ID NO:56).

In yet another aspect, the invention concerns an isolated PRO1359 polypeptide, comprising the sequence of amino acid residues 32 to about 299 of FIG. 34 (SEQ ID NO:56), or a fragment thereof sufficient to provide a binding site for an anti-PRO1359 antibody. Preferably, the PRO1359 fragment retains a qualitative biological activity of a native PRO1359 polypeptide.

In a still further aspect, the invention provides a polypeptide produced by (i) hybridizing a test DNA molecule under stringent conditions with (a) a DNA molecule encoding a PRO1359 polypeptide having the sequence of amino acid residues from about 32 to about 299, inclusive of FIG. 34 (SEQ ID NO:56), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1359 polypeptide. In a particular embodiment, the agonist or antagonist is an anti-PRO1359 antibody.

In a further embodiment, the invention concerns a method of identifying agonists or antagonists of a native PRO1359 polypeptide, by contacting the native PRO1359 polypeptide with a candidate molecule and monitoring a biological activity mediated by said polypeptide.

In a still further embodiment, the invention concerns a composition comprising a PRO1359 polypeptide, or an agonist or antagonist as hereinabove defined, in combination with a pharmaceutically acceptable carrier.

18. PRO1190

A cDNA clone (DNA59586-1520) has been identified that encodes a novel polypeptide designated in the present application as "PRO1190", and which has homology to CDO protein.

In one embodiment, the invention provides an isolated nucleic acid molecule comprising DNA encoding a PRO1190 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1190 polypeptide having the sequence of amino acid residues from about 1 to about 1115, inclusive of FIG. 36 (SEQ ID NO:58), or (b) the complement of the DNA molecule of (a).

In another aspect, the invention concerns an isolated nucleic acid molecule encoding a PRO1190 polypeptide comprising DNA hybridizing to the complement of the nucleic acid between about residues 340 and about 3684, inclusive, of FIG. 35 (SEQ ID NO:58). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203288 (DNA59586-1520), or (b) the complement of the DNA molecule of (a). In a preferred embodiment, the nucleic acid comprises a DNA encoding the same mature polypeptide encoded by the human protein cDNA in ATCC Deposit No. 203288 (DNA59586-1520).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 1115, inclusive of FIG. 36 (SEQ ID NO:58), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO190 polypeptide having the sequence of amino acid residues from about 1 to about 1115, inclusive of FIG. 36 (SEQ ID NO:58), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO190 polypeptide, with one or more of its transmembrane domains deleted or inactivated variants, or is complementary to such encoding nucleic acid molecule. The transmembrane domains have been tentatively identified in the PRO1190 amino acid sequence shown in FIG. 36 (SEQ ID NO:58) as extending from about amino acid position 16 to about amino acid position 30 and from about amino acid position 854 to about amino acid position 879.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 1115, inclusive of FIG. 36 (SEQ ID NO:58), or (b) the complement of the DNA of (a).

Another embodiment is directed to fragments of a PRO1190 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1190 polypeptide encoded by any of the isolated nucleic acid sequences hereinabove defined.

In a specific aspect, the invention provides isolated native sequence PRO1190 polypeptide, which in one embodiment, includes an amino acid sequence comprising residues 1 to 1115 of FIG. 36 (SEQ ID NO:58).

In another aspect, the invention concerns an isolated PRO1190 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 1115, inclusive of FIG. 36 (SEQ ID NO:58).

In a further aspect, the invention concerns an isolated PRO1190 polypeptide, comprising an amino acid sequence scoring at least about 80% positives, preferably at least about 85% positives, more preferably at least about 90% positives, most preferably at least about 95% positives when compared with the amino acid sequence of residues 1 to 1115 of FIG. 36 (SEQ ID NO:58).

In yet another aspect, the invention concerns an isolated PRO1190 polypeptide, comprising the sequence of amino acid residues 1 to about 1115, inclusive of FIG. 36 (SEQ ID NO:58), or a fragment thereof sufficient to provide a binding site for an anti-PRO1190 antibody. Preferably, the PRO1190 fragment retains a qualitative biological activity of a native PRO1190 polypeptide.

In a still further aspect, the invention provides a polypeptide produced by (i) hybridizing a test DNA molecule under stringent conditions with (a) a DNA molecule encoding a PRO1190 polypeptide having the sequence of amino acid residues from about 1 to about 1115, inclusive of FIG. 36 (SEQ ID NO:58), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1190 polypeptide. In a particular embodiment, the agonist or antagonist is an anti-PRO1190 antibody.

In a further embodiment, the invention concerns a method of identifying agonists or antagonists of a native PRO1190 polypeptide, by contacting the native PRO1190 polypeptide with a candidate molecule and monitoring a biological activity mediated by said polypeptide.

In a still further embodiment, the invention concerns a composition comprising a PRO1190 polypeptide, or an agonist or antagonist as hereinabove defined, in combination with a pharmaceutically acceptable carrier.

19. PRO1772

A cDNA clone (DNA59817-1703) has been identified, having homology to nucleic acid encoding peptidase enzymes, that encodes a novel polypeptide, designated in the present application as "PRO1772".

In one embodiment, the invention provides an isolated nucleic acid molecule comprising DNA encoding a PRO1772 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1772 polypeptide having the sequence of amino acid residues from about 1 or about 37 to about 487, inclusive of FIG. 38 (SEQ ID NO:63), or (b) the complement of the DNA molecule of (a).

In another aspect, the invention concerns an isolated nucleic acid molecule encoding a PRO1772 polypeptide comprising DNA hybridizing to the complement of the nucleic acid between about nucleotides 93 or about 201 and about 1553, inclusive, of FIG. 37 (SEQ ID NO:62). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203470 (DNA59817-1703) or (b) the complement of the nucleic acid molecule of (a). In a preferred embodiment, the nucleic acid comprises a DNA encoding the same mature polypeptide encoded by the human protein cDNA in ATCC Deposit No. 203470 (DNA59817-1703).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 37 to about 487, inclusive of FIG. 38 (SEQ ID NO:63), or (b) the complement of the DNA of (a).

In a further aspect, the invention concerns an isolated nucleic acid molecule having at least 415 nucleotides and produced by hybridizing a test DNA molecule under stringent conditions with (a) a DNA molecule encoding a PRO1772 polypeptide having the sequence of amino acid residues from 1 or about 37 to about 487, inclusive of FIG. 38 (SEQ ID NO:63), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1772 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 36 in the sequence of FIG. 38 (SEQ ID NO:63). The transmembrane domain has been tentatively identified as extending from about amino acid position 313 to about amino acid position 331 in the PRO1772 amino acid sequence (FIG. 38, SEQ ID NO:63).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 37 to about 487, inclusive of FIG. 38 (SEQ ID NO:63), or (b) the complement of the DNA of (a).

Another embodiment is directed to fragments of a PRO1772 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 37 (SEQ ID NO:62).

In another embodiment, the invention provides isolated PRO1772 polypeptide encoded by any of the isolated nucleic acid sequences hereinabove identified.

In a specific aspect, the invention provides isolated native sequence PRO1772 polypeptide, which in certain embodiments, includes an amino acid sequence comprising residues 1 or about 37 to about 487 of FIG. 38 (SEQ ID NO:63).

In another aspect, the invention concerns an isolated PRO1772 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 37 to about 487, inclusive of FIG. 38 (SEQ ID NO:63).

In a further aspect, the invention concerns an isolated PRO1772 polypeptide, comprising an amino acid sequence scoring at least about 80% positives, preferably at least about 85% positives, more preferably at least about 90% positives, most preferably at least about 95% positives when compared with the amino acid sequence of residues 1 or about 37 to about 487, inclusive of FIG. 38 (SEQ ID NO:63).

In yet another aspect, the invention concerns an isolated PRO1772 polypeptide, comprising the sequence of amino acid residues 1 or about 37 to about 487, inclusive of FIG. 38 (SEQ ID NO:63), or a fragment thereof sufficient to provide a binding site for an anti-PRO1772 antibody. Preferably, the PRO1772 fragment retains a qualitative biological activity of a native PRO1772 polypeptide.

In a still further aspect, the invention provides a polypeptide produced by (i) hybridizing a test DNA molecule under stringent conditions with (a) a DNA molecule encoding a PRO1772 polypeptide having the sequence of amino acid residues from about 1 or about 37 to about 487, inclusive of FIG. 38 (SEQ ID NO:63), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1772 polypeptide. In a particular embodiment, the agonist or antagonist is an anti-PRO1772 antibody.

In a further embodiment, the invention concerns a method of identifying agonists or antagonists of a native PRO1772 polypeptide by contacting the native PRO1772 polypeptide with a candidate molecule and monitoring a biological activity mediated by said polypeptide.

In a still further embodiment, the invention concerns a composition comprising a PRO1772polypeptide, or an agonist or antagonist as hereinabove defined, in combination with a pharmaceutically acceptable carrier.

20. PRO1248

A cDNA clone (DNA60278-1530) has been identified, having homology to nucleic acid encoding PUT-2, that encodes a novel polypeptide, designated in the present application as "PRO1248".

In one embodiment, the invention provides an isolated nucleic acid molecule comprising DNA encoding a PRO1248 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1248 polypeptide having the sequence of amino acid residues from about 1 or about 21 to about 183, inclusive of FIG. 40 (SEQ ID NO:68), or (b) the complement of the DNA molecule of (a).

In another aspect, the invention concerns an isolated nucleic acid molecule encoding a PRO1248 polypeptide comprising DNA hybridizing to the complement of the nucleic acid between about nucleotides 122 or about 182 and about 670, inclusive, of FIG. 39 (SEQ ID NO:67). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203170 (DNA60278-1530) or (b) the complement of the nucleic acid molecule of (a). In a preferred embodiment, the nucleic acid comprises a DNA encoding the same mature polypeptide encoded by the human protein cDNA in ATCC Deposit No. 203170 (DNA60278-1530).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 21 to about 183, inclusive of FIG. 40 (SEQ ID NO:68), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1248 polypeptide having the sequence of amino acid residues from 1 or about 21 to about 183, inclusive of FIG. 40 (SEQ ID NO:68), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1248 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 20 in the sequence of FIG. 40 (SEQ ID NO:68). The transmembrane domain has been tentatively identified as extending from about amino acid position 90 to about amino acid position 112 in the PRO1248 amino acid sequence (FIG. 40, SEQ ID NO:68).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 21 to about 183, inclusive of FIG. 40 (SEQ ID NO:68), or (b) the complement of the DNA of (a).

Another embodiment is directed to fragments of a PRO1248 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 39 (SEQ ID NO:67).

In another embodiment, the invention provides isolated PRO1248 polypeptide encoded by any of the isolated nucleic acid sequences hereinabove identified.

In a specific aspect, the invention provides isolated native sequence PRO1248 polypeptide, which in certain embodiments, includes an amino acid sequence comprising residues 1 or about 21 to about 183 of FIG. 40 (SEQ ID NO:68).

In another aspect, the invention concerns an isolated PRO1248 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 21 to about 183, inclusive of FIG. 40 (SEQ ID NO:68).

In a further aspect, the invention concerns an isolated PRO1248 polypeptide, comprising an amino acid sequence scoring at least about 80% positives, preferably at least about 85% positives, more preferably at least about 90% positives, most preferably at least about 95% positives when compared with the amino acid sequence of residues 1 or about 21 to about 183, inclusive of FIG. 40 (SEQ ID NO:68).

In yet another aspect, the invention concerns an isolated PRO1248 polypeptide, comprising the sequence of amino acid residues 1 or about 21 to about 183, inclusive of FIG. 40 (SEQ ID NO:68), or a fragment thereof sufficient to provide a binding site for an anti-PRO1248 antibody. Preferably, the PRO1248 fragment retains a qualitative biological activity of a native PRO1248 polypeptide.

In a still further aspect, the invention provides a polypeptide produced by (i) hybridizing a test DNA molecule under stringent conditions with (a) a DNA molecule encoding a PRO1248 polypeptide having the sequence of amino acid residues from about 1 or about 21 to about 183, inclusive of FIG. 40 (SEQ ID NO:68), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1248 polypeptide. In a particular embodiment, the agonist or antagonist is an anti-PRO1248 antibody.

In a further embodiment, the invention concerns a method of identifying agonists or antagonists of a native PRO1248 polypeptide by contacting the native PRO1248 polypeptide with a candidate molecule and monitoring a biological activity mediated by said polypeptide.

In a still further embodiment, the invention concerns a composition comprising a PRO1248 polypeptide, or an agonist or antagonist as hereinabove defined, in combination with a pharmaceutically acceptable carrier.

21. PRO1316

A cDNA clone (DNA60608-1577) has been identified, having homology to Dickkopf that encodes a novel polypeptide, designated in the present application as "PRO1316."

In one embodiment, the invention provides an isolated nucleic acid molecule comprising DNA encoding a PRO1316 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1316 polypeptide having the sequence of amino acid residues from 1 or about 26 to about 259, inclusive of FIG. 42 (SEQ ID NO:70), or (b) the complement of the DNA molecule of (a).

In another aspect, the invention concerns an isolated nucleic acid molecule encoding a PRO1316 polypeptide comprising DNA hybridizing to the complement of the nucleic acid between about residues 281 and about 987, inclusive, of FIG. 41 (SEQ ID NO:69). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203126 (DNA60608-1577), or (b) the complement of the DNA molecule of (a). In a preferred embodiment, the nucleic acid comprises a DNA encoding the same mature polypeptide encoded by the human protein cDNA in ATCC Deposit No. 203126 (DNA60608-1577).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 26 to about 259, inclusive of FIG. 42 (SEQ ID NO:70), or the complement of the DNA of (a).

In a further aspect, the invention concern an isolated nucleic acid molecule having at least 15 nucleotides which hybridizes under stringent conditions with (a) a DNA molecule having a identity with a region spanning either from residues 1–454 or from residues 1095–3130 of the FIG. 41 (SEQ ID NO:69), or (b) the complement of the DNA molecule of (a). Alternatively, an isolated nucleic acid molecule having at least 15 nucleotides having at least about 80% sequence identity, preferably at least about 85% sequence identity, more preferably at least about 90% sequence identity, and most preferably at least about 95% sequence identity to: (a) a DNA molecule having a identity with a region spanning either from residues 1–454 or from residues 1095–3130 of the FIG. 41 (SEQ ID NO:69), or (b) the complement of the DNA molecule of (a).

In a specific aspect, the invention provides an isolated nucleic acid molecule comprising DNA encoding a PRO1316 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 to about amino acid position 25 in the sequence of FIG. 42 (SEQ ID NO:70). An N-glycosylation site has been identified at position 52 and a fungal Zn(2)-Cys(6) binuclear cluster has been identified at position 99.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 26 to about 259, inclusive of FIG. 42 (SEQ ID NO:70), or (b) the complement of the DNA of (a).

In another embodiment, the invention provides isolated PRO1316 polypeptide encoded by any of the isolated nucleic acid sequences herein above defined.

In a specific aspect, the invention provides isolated native sequence PRO1316 polypeptide, which in one embodiment, includes an amino acid sequence comprising residues 26 to 259 of FIG. 42 (SEQ ID NO:70).

In another aspect, the invention concerns an isolated PRO1316 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 26 to about 259, inclusive of FIG. 42 (SEQ ID NO:70).

In a further aspect, the invention concerns an isolated PRO1316 polypeptide, comprising an amino acid sequence scoring at least about 80% positives, preferably at least about 85% positives, more preferably at least about 90% positives, most preferably at least about 95% positives when compared with the amino acid sequence of residues 26 to 259 of FIG. 42 (SEQ ID NO:70).

In yet another aspect, the invention concerns an isolated PRO1316 polypeptide, comprising the sequence of amino acid residues 26 to about 259, inclusive of FIG. 42 (SEQ ID NO:70), or a fragment thereof sufficient to provide a binding site for an anti-PRO1316 antibody. Preferably, the PRO1316 fragment retains a qualitative biological activity of a native PRO1316 polypeptide.

In a still further aspect, the invention provides a polypeptide produced by (i) hybridizing a test DNA molecule under stringent conditions with (a) a DNA molecule encoding a PRO1316 polypeptide having the sequence of amino acid residues from about 26 to about 259, inclusive of FIG. 42 (SEQ ID NO:70), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO1316 polypeptide. In a particular embodiment, the agonist or antagonist is an anti-PRO1316 antibody.

In a further embodiment, the invention concerns a method of identifying agonists or antagonists of a native PRO1316 polypeptide, by contacting the native PRO1316 polypeptide with a candidate molecule and monitoring a biological activity mediated by said polypeptide.

In a still further embodiment, the invention concerns a composition comprising a PRO11316 polypeptide, or an agonist or antagonist as herein above defined, in combination with a pharmaceutically acceptable carrier.

22. PRO1197

A cDNA clone (DNA60611-1524) has been identified that encodes a novel secreted polypeptide designated in the present application as "PRO1197."

In one embodiment, the invention provides an isolated nucleic acid molecule comprising DNA encoding a PRO1197 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1197 polypeptide having the sequence of amino acid residues from 1 or about 25 to about 363, inclusive of FIG. 44 (SEQ ID NO:72), or (b) the complement of the DNA molecule of (a).

In another aspect, the invention concerns an isolated nucleic acid molecule encoding a PRO1197 polypeptide comprising DNA hybridizing to the complement of the nucleic acid between about residues 383 and about 1399, inclusive, of FIG. 43 (SEQ ID NO:71). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203175 (DNA60611-1524), or (b) the complement of the DNA molecule of (a). In a preferred embodiment, the nucleic acid comprises a DNA encoding the same mature polypeptide encoded by the human protein cDNA in ATCC Deposit No. 203175 (DNA60611-1524).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 25 to about 363, inclusive of FIG. 44 (SEQ ID NO:72), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1197 polypeptide having the sequence of amino acid residues from about 25 to about 363, inclusive of FIG. 44 (SEQ ID NO:72), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 25 to about 363, inclusive of FIG. 44 (SEQ ID NO:72), or (b) the complement of the DNA of (a).

Another embodiment is directed to fragments of a PRO1197 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1197 polypeptide encoded by any of the isolated nucleic acid sequences hereinabove defined.

In a specific aspect, the invention provides isolated native sequence PRO1197 polypeptide, which in one embodiment, includes an amino acid sequence comprising residues 25 through 363 of FIG. 44 (SEQ ID NO:72).

In another aspect, the invention concerns an isolated PRO1197 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 25 to about 363, inclusive of FIG. 44 (SEQ ID NO:72).

In a further aspect, the invention concerns an isolated PRO1197 polypeptide, comprising an amino acid sequence scoring at least about 80% positives, preferably at least about 85% positives, more preferably at least about 90% positives, most preferably at least about 95% positives when compared with the amino acid sequence of residues 25 through 363 of FIG. 44 (SEQ ID NO:72).

In yet another aspect, the invention concerns an isolated PRO1197 polypeptide, comprising the sequence of amino acid residues 25 to about 363, inclusive of FIG. 44 (SEQ ID NO:72), or a fragment thereof sufficient to provide a binding site for an anti-PRO1197 antibody. Preferably, the PRO1197 fragment retains a qualitative biological activity of a native PRO1197 polypeptide.

In a still further aspect, the invention provides a polypeptide produced by (i) hybridizing a test DNA molecule under stringent conditions with (a) a DNA molecule encoding a PRO1197 polypeptide having the sequence of amino acid residues from about 25 to about 363, inclusive of FIG. 44 (SEQ ID NO:72), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1197 polypeptide. In a particular embodiment, the agonist or antagonist is an anti-PRO1197 antibody.

23. PRO1293

A cDNA clone (DNA60618-1557) has been identified, having homology to nucleic acid encoding an immunoglobulin heavy chain variable region protein that encodes a novel polypeptide, designated in the present application as "PRO1293".

In one embodiment, the invention provides an isolated nucleic acid molecule comprising DNA encoding a PRO1293 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1293 polypeptide having the sequence of amino acid residues from about 1 or about 20 to about 341, inclusive of FIG. 46 (SEQ ID NO:77), or (b) the complement of the DNA molecule of (a).

In another aspect, the invention concerns an isolated nucleic acid molecule encoding a PRO1293 polypeptide comprising DNA hybridizing to the complement of the nucleic acid between about nucleotides 37 or about 94 and about 1059, inclusive, of FIG. 45 (SEQ ID NO:76).

Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203292 (DNA60618-1557) or (b) the complement of the nucleic acid molecule of (a). In a preferred embodiment, the nucleic acid comprises a DNA encoding the same mature polypeptide encoded by the human protein cDNA in ATCC Deposit No. 203292 (DNA60618-1557).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 20 to about 341, inclusive of FIG. 46 (SEQ ID NO:77), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1293 polypeptide having the sequence of amino acid residues from 1 or about 20 to about 341, inclusive of FIG. 46 (SEQ ID NO:77), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1293 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 19 in the sequence of FIG. 46 (SEQ ID NO:77). The transmembrane domain has been tentatively identified as extending from about amino acid position 237 to about amino acid position 262 in the PRO1293 amino acid sequence (FIG. 46, SEQ ID NO:77).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 20 to about 341, inclusive of FIG. 46 (SEQ ID NO:77), or (b) the complement of the DNA of (a).

Another embodiment is directed to fragments of a PRO1293 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 45 (SEQ ID NO:76).

In another embodiment, the invention provides isolated PRO1293 polypeptide encoded by any of the isolated nucleic acid sequences hereinabove identified.

In a specific aspect, the invention provides isolated native sequence PRO1293 polypeptide, which in certain embodiments, includes an amino acid sequence comprising residues 1 or about 20 to about 341 of FIG. 46 (SEQ ID NO:77).

In another aspect, the invention concerns an isolated PRO1293 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 20 to about 341, inclusive of FIG. 46 (SEQ ID NO:77).

In a further aspect, the invention concerns an isolated PRO1293 polypeptide, comprising an amino acid sequence scoring at least about 80% positives, preferably at least about 85% positives, more preferably at least about 90% positives, most preferably at least about 95% positives when compared with the amino acid sequence of residues 1 or about 20 to about 341, inclusive of FIG. 46 (SEQ ID NO:77).

In yet another aspect, the invention concerns an isolated PRO1293 polypeptide, comprising the sequence of amino acid residues 1 or about 20 to about 341, inclusive of FIG. 46 (SEQ ID NO:77), or a fragment thereof sufficient to provide a binding site for an anti-PRO1293 antibody. Preferably, the PRO1293 fragment retains a qualitative biological activity of a native PRO1293 polypeptide.

In a still further aspect, the invention provides a polypeptide produced by (i) hybridizing a test DNA molecule under stringent conditions with (a) a DNA molecule encoding a PRO1293 polypeptide having the sequence of amino acid residues from about 1 or about 20 to about 341, inclusive of FIG. 46 (SEQ ID NO:77), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1293 polypeptide. In a particular embodiment, the agonist or antagonist is an anti-PRO1293 antibody.

In a further embodiment, the invention concerns a method of identifying agonists or antagonists of a native PRO1293 polypeptide by contacting the native PRO1293 polypeptide with a candidate molecule and monitoring a biological activity mediated by said polypeptide.

In a still further embodiment, the invention concerns a composition comprising a PRO1293 polypeptide, or an agonist or antagonist as hereinabove defined, in combination with a pharmaceutically acceptable carrier.

24. PRO1380

A cDNA clone (DNA60740-1615) has been identified that encodes a novel multi-span transmembrane polypeptide designated in the present application as "PRO1380".

In one embodiment, the invention provides an isolated nucleic acid molecule comprising DNA encoding a PRO1380 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1380 polypeptide having the sequence of amino acid residues from about 1 to about 470, inclusive of FIG. 48 (SEQ ID NO:79), or (b) the complement of the DNA molecule of (a).

In another aspect, the invention concerns an isolated nucleic acid molecule encoding a PRO1380 polypeptide comprising DNA hybridizing to the complement of the nucleic acid between about residues 36 and about 1460, inclusive, of FIG. 47 (SEQ ID NO:78). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203456 (DNA60740-1615), or (b) the complement of the DNA molecule of (a). In a preferred embodiment, the nucleic acid comprises a DNA encoding the same mature polypeptide encoded by the human protein cDNA in ATCC Deposit No. 203456 (DNA60740-1615).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 470, inclusive of FIG. 48 (SEQ ID NO:79), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1380 polypeptide having the sequence of amino acid residues from about 1 to about 470, inclusive of FIG. 48 (SEQ ID NO:79), or (b) the complement of the DNA molecule of (a), and, if the DNA molecule has at least about 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1380 polypeptide, and its soluble variants (i.e. one or more transmembrane domains deleted or inactivated), or is complementary to such encoding nucleic acid molecule. Transmembrane domains have been tentatively identified at about the following amino acid positions: 50–74, 105–127, 135–153, 163–183, 228–252, 305–330, and 448–472 in the PRO1380 amino acid sequence (FIG. 48, SEQ ID NO:79).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 470, inclusive of FIG. 48 (SEQ ID NO:79), or (b) the complement of the DNA of (a).

Another embodiment is directed to fragments of a PRO1380 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1380 polypeptide encoded by any of the isolated nucleic acid sequences hereinabove defined.

In a specific aspect, the invention provides isolated native sequence PRO1380 polypeptide, which in one embodiment, includes an amino acid sequence comprising residues 1 to 470 of FIG. 48 (SEQ ID NO:79).

In another aspect, the invention concerns an isolated PRO1380 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 470, inclusive of FIG. 48 (SEQ ID NO:79).

In a further aspect, the invention concerns an isolated PRO1380 polypeptide, comprising an amino acid sequence scoring at least about 80% positives, preferably at least about 85% positives, more preferably at least about 90% positives, most preferably at least about 95% positives when compared with the amino acid sequence of residues 1 to 470 of FIG. 48 (SEQ ID NO:79).

In yet another aspect, the invention concerns an isolated PRO1380 polypeptide, comprising the sequence of amino acid residues 1 to about 470, inclusive of FIG. 48 (SEQ ID NO:79), or a fragment thereof sufficient to provide a binding site for an anti-PRO1380 antibody. Preferably, the PRO1380 fragment retains a qualitative biological activity of a native PRO1380 polypeptide.

In a still further aspect, the invention provides a polypeptide produced by (i) hybridizing a test DNA molecule under stringent conditions with (a) a DNA molecule encoding a PRO1380 polypeptide having the sequence of amino acid residues from about 1 to about 470, inclusive of FIG. 48 (SEQ ID NO:79), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

25. PRO1265

A cDNA clone (DNA60764-1533) has been identified that encodes a novel polypeptide having homology to the FIG. 1 polypeptide and designated in the present application as "PRO1265."

In one embodiment, the invention provides an isolated nucleic acid molecule comprising DNA encoding a PRO1265 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1265 polypeptide having the sequence of amino acid residues from 1 or about about 22 to about 567, inclusive of FIG. 50 (SEQ ID NO:84), or (b) the complement of the DNA molecule of (a).

In another aspect, the invention concerns an isolated nucleic acid molecule encoding a PRO1265 polypeptide comprising DNA hybridizing to the complement of the nucleic acid between about residues 142 and about 1779, inclusive, of FIG. 49 (SEQ ID NO:83). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203452 (DNA60764-1533), or (b) the complement of the DNA molecule of (a). In a preferred embodiment, the nucleic acid comprises a DNA encoding the same mature polypeptide encoded by the human protein cDNA in ATCC Deposit No. 203452 (DNA60764-1533).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 22 to about 567, inclusive of FIG. 50 (SEQ ID NO:84), or the complement of the DNA of (a).

In a further aspect, the invention concerns an isolated nucleic acid molecule having at least about 50nucleotides, and preferably at least about 100 nucleotides and produced by hybridizing a test DNA molecule under stringent conditions with (a) a DNA molecule encoding a PRO1265 polypeptide having the sequence of amino acid residues from about 22 to about 567, inclusive of FIG. 50 (SEQ ID NO:84), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1265 polypeptide, with or without the N-terminal signal sequence and/or the initiating methionine, or is complementary to such encoding nucleic acid molecule. The signal peptide has been tentatively identified as extending from amino acid position 1 through about amino acid position 21 in the sequence of FIG. 50 (SEQ ID NO:84).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 22 to about 567, inclusive of FIG. 50 (SEQ ID NO:84), or (b) the complement of the DNA of (a).

Another embodiment is directed to fragments of a PRO1265 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about nucleotides in length.

In another embodiment, the invention provides isolated PRO1265 polypeptide encoded by any of the isolated nucleic acid sequences hereinabove defined.

In a specific aspect, the invention provides isolated native sequence PRO1265 polypeptide, which in one embodiment, includes an amino acid sequence comprising residues 1 or about 22 to 567 of FIG. 50 (SEQ ID NO:84).

In another aspect, the invention concerns an isolated PRO1265 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 22 to about 567, inclusive of FIG. 50 (SEQ ID NO:84).

In a further aspect, the invention concerns an isolated PRO1265 polypeptide, comprising an amino acid sequence scoring at least about 80% positives, preferably at least about 85% positives, more preferably at least about 90% positives, most preferably at least about 95% positives when compared with the amino acid sequence of residues 22 to 567 of FIG. 50 (SEQ ID NO:84).

In yet another aspect, the invention concerns an isolated PRO1265 polypeptide, comprising the sequence of amino acid residues 22 to about 567, inclusive of FIG. 50 (SEQ ID NO:84), or a fragment thereof sufficient to provide a binding site for an anti-PRO1265 antibody. Preferably, the PRO1265 fragment retains a qualitative biological activity of a native PRO1265 polypeptide.

In a still further aspect, the invention provides a polypeptide produced by (i) hybridizing a test DNA molecule under stringent conditions with (a) a DNA molecule encoding a PRO1265 polypeptide having the sequence of amino acid residues from about 22 to about 567, inclusive of FIG. 50 (SEQ ID NO:84), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

26. PRO1250

A cDNA clone (DNA60775-1532) has been identified, having homology to nucleic acid encoding long chain fatty acid CoA ligase that encodes a novel polypeptide, designated in the present application as "PRO1250".

In one embodiment, the invention provides an isolated nucleic acid molecule comprising DNA encoding a PRO1250 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1250 polypeptide having the sequence of amino acid residues from about 1 to about 739, inclusive of FIG. 52 (SEQ ID NO:86), or (b) the complement of the DNA molecule of (a).

In another aspect, the invention concerns an isolated nucleic acid molecule encoding a PRO1250 polypeptide comprising DNA hybridizing to the complement of the nucleic acid between about nucleotides 74 and about 2290, inclusive, of FIG. 51 (SEQ ID NO:85). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203173 (DNA60775-1532) or (b) the complement of the nucleic acid molecule of (a). In a preferred embodiment, the nucleic acid comprises a DNA encoding the same mature polypeptide encoded by the human protein cDNA in ATCC Deposit No. 203173 (DNA60775-1532).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 739, inclusive of FIG. 52 (SEQ ID NO:86), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1250 polypeptide having the sequence of amino acid residues from 1 to about 739, inclusive of FIG. 52 (SEQ ID NO:86), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1250 polypeptide, with or without the initiating methionine, and its soluble, i.e., transmembrane domain deleted or inactivated variants, or is complementary to such encoding nucleic acid molecule. The type II transmembrane domain has been tentatively identified as extending from about amino acid position 61 to about amino acid position 80 in the PRO1250 amino acid sequence (FIG. 52, SEQ ID NO:86).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 739, inclusive of FIG. 52 (SEQ ID NO:86), or (b) the complement of the DNA of (a).

Another embodiment is directed to fragments of a PRO1250 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 51 (SEQ ID NO:85).

In another embodiment, the invention provides isolated PRO1250 polypeptide encoded by any of the isolated nucleic acid sequences hereinabove identified.

In a specific aspect, the invention provides isolated native sequence PRO1250 polypeptide, which in certain embodiments, includes an amino acid sequence comprising residues 1 to about 739 of FIG. 52 (SEQ ID NO:86).

In another aspect, the invention concerns an isolated PRO1250 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 739, inclusive of FIG. 52 (SEQ ID NO:86).

In a further aspect, the invention concerns an isolated PRO1250 polypeptide, comprising an amino acid sequence scoring at least about 80% positives, preferably at least about 85% positives, more preferably at least about 90% positives, most preferably at least about 95% positives when compared with the amino acid sequence of residues 1 to about 739, inclusive of FIG. 52 (SEQ ID NO:86).

In yet another aspect, the invention concerns anisolated PRO1250 polypeptide, comprising the sequence of amino acid residues 1 to about 739, inclusive of FIG. 52 (SEQ ID NO:86), or a fragment thereof sufficient to provide a binding site for an anti-PRO1250 antibody. Preferably, the PRO1250 fragment retains a qualitative biological activity of a native PRO1250 polypeptide.

In a still further aspect, the invention provides a polypeptide produced by (i) hybridizing a test DNA molecule under stringent conditions with (a) a DNA molecule encoding a PRO1250 polypeptide having the sequence of amino acid residues from about 1 to about 739, inclusive of FIG. 52 (SEQ ID NO:86), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1250 polypeptide. In a particular embodiment, the agonist or antagonist is an anti-PRO1250 antibody.

In a further embodiment, the invention concerns a method of identifying agonists or antagonists of a native PRO1250 polypeptide by contacting the native PRO1250 polypeptide with a candidate molecule and monitoring a biological activity mediated by said polypeptide.

In a still further embodiment, the invention concerns a composition comprising a PRO1250 polypeptide, or an agonist or antagonist as hereinabove defined, in combination with a pharmaceutically acceptable carrier.

27. PRO1475

A cDNA clone (DNA61185-1646) has been identified, having homology to nucleic acid encoding an N-acetylglucosaminyltransferase that encodes a novel polypeptide, designated in the present application as "PRO1475".

In one embodiment, the invention provides an isolated nucleic acid molecule comprising DNA encoding a PRO1475 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1475 polypeptide having the sequence of amino acid residues from about 1 to about 660, inclusive of FIG. 54 (SEQ ID NO:88), or (b) the complement of the DNA molecule of (a).

In another aspect, the invention concerns an isolated nucleic acid molecule encoding a PRO1475 polypeptide comprising DNA hybridizing to the complement of the nucleic acid between about nucleotides 130 and about 2109, inclusive, of FIG. 53 (SEQ ID NO:87). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203464 (DNA61185-1646) or (b) the complement of the nucleic acid molecule of (a). In a preferred embodiment, the nucleic acid comprises a DNA encoding the same mature polypeptide encoded by the human protein cDNA in ATCC Deposit No. 203464 (DNA61185-1646).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 660, inclusive of FIG. 54 (SEQ ID NO:88), or (b) the complement of the DNA of (a).

In a further aspect, the invention concerns an isolated nucleic acid molecule having at least 180 nucleotides and produced by hybridizing a test DNA molecule under stringent conditions with (a) a DNA molecule encoding a PRO1475 polypeptide having the sequence of amino acid residues from 1 to about 660, inclusive of FIG. 54 (SEQ ID NO:88), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1475 polypeptide, with or without the initiating methionine, and its soluble, i.e., transmembrane domain deleted or inactivated variants, or is complementary to such encoding nucleic acid molecule. The transmembrane domain has been tentatively identified as extending from about amino acid position 38 to about amino acid position 55 in the PRO1475 amino acid sequence (FIG. 54, SEQ ID NO:88).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 660, inclusive of FIG. 54 (SEQ ID NO:88), or (b) the complement of the DNA of (a).

Another embodiment is directed to fragments of a PRO1475 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 53 (SEQ ID NO:87).

In another embodiment, the invention provides isolated PRO1475 polypeptide encoded by any of the isolated nucleic acid sequences hereinabove identified.

In a specific aspect, the invention provides isolated native sequence PRO1475 polypeptide, which in certain embodiments, includes an amino acid sequence comprising residues 1 to about 660 of FIG. 54 (SEQ ID NO:88).

In another aspect, the invention concerns an isolated PRO1475 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 660, inclusive of FIG. 54 (SEQ ID NO:88).

In a further aspect, the invention concerns an isolated PRO1475 polypeptide, comprising an amino acid sequence scoring at least about 80% positives, preferably at least about 85% positives, more preferably at least about 90% positives, most preferably at least about 95% positives when compared with the amino acid sequence of residues 1 to about 660, inclusive of FIG. 54 (SEQ ID NO:88).

In yet another aspect, the invention concerns an isolated PRO1475 polypeptide, comprising the sequence of amino acid residues 1 to about 660, inclusive of FIG. 54 (SEQ ID NO:88), or a fragment thereof sufficient to provide a binding site for an anti-PRO1475 antibody. Preferably, the PRO1475 fragment retains a qualitative biological activity of a native PRO1475 polypeptide.

In a still further aspect, the invention provides a polypeptide produced by (i) hybridizing a test DNA molecule under stringent conditions with (a) a DNA molecule encoding a PRO1475 polypeptide having the sequence of amino acid residues from about 1 to about 660, inclusive of FIG. 54 (SEQ ID NO:88), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1475 polypeptide. In a particular embodiment, the agonist or antagonist is an anti-PRO1475 antibody.

In a further embodiment, the invention concerns a method of identifying agonists or antagonists of a native PRO1475 polypeptide by contacting the native PRO1475 polypeptide with a candidate molecule and monitoring a biological activity mediated by said polypeptide.

In a still further embodiment, the invention concerns a composition comprising a PRO1475 polypeptide, or an agonist or antagonist as hereinabove defined, in combination with a pharmaceutically acceptable carrier.

28. PRO1377

A cDNA clone (DNA61608-1606) has been identified that encodes a novel multi-span transmembrane polypeptide designated in the present application as "PRO1377."

In one embodiment, the invention provides an isolated nucleic acid molecule comprising DNA encoding a PRO1377 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1377 polypeptide having the sequence of amino acid residues from 1 or about 19 to about 307, inclusive of FIG.

56 (SEQ ID NO:95), or (b) the complement of the DNA molecule of (a).

In another aspect, the invention concerns an isolated nucleic acid molecule encoding a PRO1377 polypeptide comprising DNA hybridizing to the complement of the nucleic acid between about residues 203 and about 1069, inclusive, of FIG. 55 (SEQ ID NO:94). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203239 (DNA61608-1606), or (b) the complement of the DNA molecule of (a). In a preferred embodiment, the nucleic acid comprises a DNA encoding the same mature polypeptide encoded by the human protein cDNA in ATCC Deposit No. 203239 (DNA61608-1606).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 307, inclusive of FIG. 56 (SEQ ID NO:95), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1377 polypeptide having the sequence of amino acid residues from about 19 to about 307, inclusive of FIG. 56 (SEQ ID NO:95), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1377 polypeptide, with or without the N-terminal signal sequence and/or the initiating methionine, and one or more of its transmembrane domains deleted or inactivated, or is complementary to such encoding nucleic acid molecule. The signal peptide has been tentatively identified as extending from amino acid position 1 through about amino acid position 18 in the sequence of FIG. 56 (SEQ ID NO:95). Transmembrane domain has been tentatively identified as extending from about amino acid positions 37–56, 106–122, 211–20, 240–260, and 288–304 in the PRO1377 amino acid sequence (FIG. 56, SEQ ID NO:95).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 307, inclusive of FIG. 56 (SEQ ID NO:95), or (b) the complement of the DNA of (a).

Another embodiment is directed to fragments of a PRO1377 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1377 polypeptide encoded by any of the isolated nucleic acid sequences hereinabove defined.

In a specific aspect, the invention provides isolated native sequence PRO1377 polypeptide, which in one embodiment, includes an amino acid sequence comprising residues 19 to 307 of FIG. 56 (SEQ ID NO:95).

In another aspect, the invention concerns an isolated PRO1377 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 307, inclusive of FIG. 56 (SEQ ID NO:95).

In a further aspect, the invention concerns an isolated PRO1377 polypeptide, comprising an amino acid sequence scoring at least about 80% positives, preferably at least about 85% positives, more preferably at least about 90% positives, most preferably at least about 95% positives when compared with the amino acid sequence of residues 19 to 307 of FIG. 56 (SEQ ID NO:95).

In yet another aspect, the invention concerns an isolated PRO1377 polypeptide, comprising the sequence of amino acid residues 19 to about 307, inclusive of FIG. 56 (SEQ ID NO:95), or a fragment thereof sufficient to provide a binding site for an anti-PRO1377 antibody. Preferably, the PRO1377 fragment retains a qualitative biological activity of a native PRO1377 polypeptide.

In a still further aspect, the invention provides a polypeptide produced by (i) hybridizing a test DNA molecule under stringent conditions with (a) a DNA molecule encoding a PRO1377 polypeptide having the sequence of amino acid residues from about 19 to about 307, inclusive of FIG. 56 (SEQ ID NO:95), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

29. PRO1326

A cDNA clone (DNA62808-1582) has been identified that encodes a novel secreted polypeptide designated in the present application as "PRO1326."

In one embodiment, the invention provides an isolated nucleic acid molecule comprising DNA encoding a PRO1326 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1326 polypeptide having the sequence of amino acid residues from 1 or about 30 to about 401, inclusive of FIG. 58 (SEQ ID NO:100), or (b) the complement of the DNA molecule of (a).

In another aspect, the invention concerns an isolated nucleic acid molecule encoding a PRO1326 polypeptide comprising DNA hybridizing to the complement of the nucleic acid between about residues 199 and about 1314, inclusive, of FIG. 57 (SEQ ID NO:99). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203358 (DNA62808-1582), or (b) the complement of the DNA molecule of (a). In a preferred embodiment, the nucleic acid comprises a DNA encoding the same mature polypeptide encoded by the human protein cDNA in ATCC Deposit No. 203358 (DNA62808-1582).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 30 to about 401, inclusive of FIG. 58 (SEQ ID NO:100), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1326 polypeptide having the sequence of amino acid residues from about 30 to about 401, inclusive of FIG. 58 (SEQ ID NO:100), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1326 polypeptide, with or without the N-terminal signal sequence and/or the initiating methionine, or is complementary to such encoding nucleic acid molecule. The signal peptide has been tentatively identified as extending from amino acid position 1 through about amino acid position 29 in the sequence of FIG. 58 (SEQ ID NO:100).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 30 to about 401, inclusive of FIG. 58 (SEQ ID NO:100), or (b) the complement of the DNA of (a).

Another embodiment is directed to fragments of a PRO1326 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1326 polypeptide encoded by any of the isolated nucleic acid sequences hereinabove defined.

In a specific aspect, the invention provides isolated native sequence PRO1326 polypeptide, which in one embodiment, includes an amino acid sequence comprising residues 30 to 401 of FIG. 58 (SEQ ID NO:100).

In another aspect, the invention concerns an isolated PRO1326 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 30 to about 401, inclusive of FIG. 58 (SEQ ID NO:100).

In a further aspect, the invention concerns an isolated PRO1326 polypeptide, comprising an amino acid sequence scoring at least about 80% positives, preferably at least about 85% positives, more preferably at least about 90% positives, most preferably at least about 95% positives when compared with the amino acid sequence of residues 30 to 401 of FIG. 58 (SEQ ID NO:100).

In yet another aspect, the invention concerns an isolated PRO1326 polypeptide, comprising the sequence of amino acid residues 30 to about 401, inclusive of FIG. 58 (SEQ ID NO:100), or a fragment thereof sufficient to provide a binding site for an anti-PRO1326 antibody. Preferably, the PRO1326 fragment retains a qualitative biological activity of a native PRO1326 polypeptide.

In a still further aspect, the invention provides a polypeptide produced by (i) hybridizing a test DNA molecule under stringent conditions with (a) a DNA molecule encoding a PRO1326 polypeptide having the sequence of amino acid residues from about 30 to about 401, inclusive of FIG. 58 (SEQ ID NO:100), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

30. PRO1249

A cDNA clone (DNA62809-1531) has been identified that encodes a novel transmembrane polypeptide, designated in the present application as "PRO1249".

In one embodiment, the invention provides an isolated nucleic acid molecule comprising DNA encoding a PRO1249 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1249 polypeptide having the sequence of amino acid residues from about 1 or about 17 to about 1089, inclusive of FIG. 60 (SEQ ID NO:102), or (b) the complement of the DNA molecule of (a).

In another aspect, the invention concerns an isolated nucleic acid molecule encoding a PRO1249 polypeptide comprising DNA hybridizing to the complement of the nucleic acid between about nucleotides 3 or about 51 and about 3269, inclusive, of FIG. 59 (SEQ ID NO:101). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203237 (DNA62809-1531) or (b) the complement of the nucleic acid molecule of (a). In a preferred embodiment, the nucleic acid comprises a DNA encoding the same mature polypeptide encoded by the human protein cDNA in ATCC Deposit No. 203237 (DNA62809-1531).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 17 to about 1089, inclusive of FIG. 60 (SEQ ID NO:102), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1249 polypeptide having the sequence of amino acid residues from 1 or about 17 to about 1089, inclusive of FIG. 60 (SEQ ID NO:102), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1249 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 16 in the sequence of FIG. 60 (SEQ ID NO:102). The transmembrane domains have been tentatively identified as extending from about amino acid position 317 to about amino acid position 341, from about amino acid position 451 to about amino acid position 470, from about amino acid position 481 to about amino acid position 500, from about amino acid position 510 to about amino acid position 527, from about amino acid position 538 to about amino acid position 555, from about amino acid position 831 to about amino acid position 850, from about amino acid position 1016 to about amino acid position 1034 and from about amino acid position 1052 to about amino acid position 1070 in the PRO1249 amino acid sequence (FIG. 60, SEQ ID NO:102).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 17 to about 1089, inclusive of FIG. 60 (SEQ ID NO:102), or (b) the complement of the DNA of (a).

Another embodiment is directed to fragments of a PRO1249 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 59 (SEQ ID NO:101).

In another embodiment, the invention provides isolated PRO1249 polypeptide encoded by any of the isolated nucleic acid sequences hereinabove identified.

In a specific aspect, the invention provides isolated native sequence PRO1249 polypeptide, which in certain embodiments, includes an amino acid sequence comprising residues 1 or about 17 to about 1089 of FIG. 60 (SEQ ID NO:102).

In another aspect, the invention concerns an isolated PRO1249 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 17 to about 1089, inclusive of FIG. 60 (SEQ ID NO:102).

In a further aspect, the invention concerns an isolated PRO1249 polypeptide, comprising an amino acid sequence scoring at least about 80% positives, preferably at least about 85% positives, more preferably at least about 90% positives, most preferably at least about 95% positives when compared with the amino acid sequence of residues 1 or about 17 to about 1089, inclusive of FIG. 60 (SEQ ID NO:102).

In yet another aspect, the invention concerns an isolated PRO1249 polypeptide, comprising the sequence of amino acid residues 1 or about 17 to about 1089, inclusive of FIG. 60 (SEQ ID NO:102), or a fragment thereof sufficient to provide a binding site for an anti-PRO1249 antibody. Preferably, the PRO1249 fragment retains a qualitative biological activity of a native PRO1249 polypeptide.

In a still further aspect, the invention provides a polypeptide produced by (i) hybridizing a test DNA molecule under stringent conditions with (a) a DNA molecule encoding a PRO1249 polypeptide having the sequence of amino acid residues from about 1 or about 17 to about 1089, inclusive of FIG. 60 (SEQ ID NO:102), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

31. PRO1315

A cDNA clone (DNA62815-1576) has been identified, having homology to nucleic acid encoding cytokine receptor family-4 proteins that encodes a novel polypeptide, designated in the present application as "PRO1315".

In one embodiment, the invention provides an isolated nucleic acid molecule comprising DNA encoding a PRO1315 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1315 polypeptide having the sequence of amino acid residues from about 1 or about 29 to about 442, inclusive of FIG. 62 (SEQ ID NO:104), or (b) the complement of the DNA molecule of (a).

In another aspect, the invention concerns an isolated nucleic acid molecule encoding a PRO1315 polypeptide comprising DNA hybridizing to the complement of the nucleic acid between about nucleotides 121 or about 205 and about 1446, inclusive, of FIG. 61 (SEQ ID NO:103). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203247 (DNA62815-1576) or (b) the complement of the nucleic acid molecule of (a). In a preferred embodiment, the nucleic acid comprises a DNA encoding the same mature polypeptide encoded by the human protein cDNA in ATCC Deposit No. 203247 (DNA62815-1576).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 29 to about 442, inclusive of FIG. 62 (SEQ ID NO:104), or (b) the complement of the DNA of (a).

In a further aspect, the invention concerns an isolated nucleic acid molecule having at least 500 nucleotides and produced by hybridizing a test DNA molecule under stringent conditions with (a) a DNA molecule encoding a PRO1315 polypeptide having the sequence of amino acid residues from 1 or about 29 to about 442, inclusive of FIG. 62 (SEQ ID NO:104), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1315 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 28 in the sequence of FIG. 62 (SEQ ID NO:104). The transmembrane domain has been tentatively identified as extending from about amino acid position 140 to about amino acid position 163 in the PRO1315 amino acid sequence (FIG. 62, SEQ ID NO:104).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 29 to about 442, inclusive of FIG. 62 (SEQ ID NO:104), or (b) the complement of the DNA of (a).

Another embodiment is directed to fragments of a PRO1315 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 61 (SEQ ID NO:103).

In another embodiment, the invention provides isolated PRO1315 polypeptide encoded by any of the isolated nucleic acid sequences hereinabove identified.

In a specific aspect, the invention provides isolated native sequence PRO1315 polypeptide, which in certain embodiments, includes an amino acid sequence comprising residues 1 or about 29 to about 442 of FIG. 62 (SEQ ID NO:104).

In another aspect, the invention concerns an isolated PRO1315 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 29 to about 442, inclusive of FIG. 62 (SEQ ID NO:104).

In a further aspect, the invention concerns an isolated PRO1315 polypeptide, comprising an amino acid sequence scoring at least about 80% positives, preferably at least about 85% positives, more preferably at least about 90% positives, most preferably at least about 95% positives when compared with the amino acid sequence of residues 1 or about 29 to about 442, inclusive of FIG. 62 (SEQ ID NO:104).

In yet another aspect, the invention concerns an isolated PRO1315 polypeptide, comprising the sequence of amino acid residues 1 or about 29 to about 442, inclusive of FIG. 62 (SEQ ID NO:104), or a fragment thereof sufficient to provide a binding site for an anti-PRO1315 antibody. Preferably, the PRO1315 fragment retains a qualitative biological activity of a native PRO1315 polypeptide.

In a still further aspect, the invention provides a polypeptide produced by (i) hybridizing a test DNA molecule under stringent conditions with (a) a DNA molecule encoding a PRO1315 polypeptide having the sequence of amino acid residues from about 1 or about 29 to about 442, inclusive of FIG. 62 (SEQ ID NO:104), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1315 polypeptide. In a particular embodiment, the agonist or antagonist is an anti-PRO1315 antibody.

In a further embodiment, the invention concerns a method of identifying agonists or antagonists of a native PRO1315 polypeptide by contacting the native PRO1315 polypeptide with a candidate molecule and monitoring a biological activity mediated by said polypeptide.

In a still further embodiment, the invention concerns a composition comprising a PRO1315 polypeptide, or an agonist or antagonist as hereinabove defined, in combination with a pharmaceutically acceptable carrier.

32. PRO1599

A cDNA clone (DNA62845-1684) has been identified that encodes a novel polypeptide having homology to Granzyme M and designated in the present application as "PRO1599."

In one embodiment, the invention provides an isolated nucleic acid molecule comprising DNA encoding a PRO1599 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1599 polypeptide having the sequence of amino acid residues from 1 or about 31 to about 283, inclusive of FIG.

64 (SEQ ID NO:111), or (b) the complement of the DNA molecule of (a).

In another aspect, the invention concerns an isolated nucleic acid molecule encoding a PRO1599 polypeptide comprising DNA hybridizing to the complement of the nucleic acid between about residues 159 and about 917, inclusive, of FIG. 63 (SEQ ID NO:110). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203361 (DNA62845-1684), or (b) the complement of the DNA molecule of (a). In a preferred embodiment, the nucleic acid comprises a DNA encoding the same mature polypeptide encoded by the human protein cDNA in ATCC Deposit No. 203361 (DNA62845-1684).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 31 to about 283, inclusive of FIG. 64 (SEQ ID NO:111), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1599 polypeptide having the sequence of amino acid residues from about 31 to about 283, inclusive of FIG. 64 (SEQ ID NO:111), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1599 polypeptide, with or without the N-terminal signal sequence and/or the initiating methionine, or is complementary to such encoding nucleic acid molecule. The signal peptide has been tentatively identified as extending from amino acid position 1 through about amino acid position 30 in the sequence of FIG. 64 (SEQ ID NO:111).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 31 to about 283, inclusive of FIG. 64 (SEQ ID NO:111), or (b) the complement of the DNA of (a).

Another embodiment is directed to fragments of a PRO1599 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1599 polypeptide encoded by any of the isolated nucleic acid sequences hereinabove defined.

In a specific aspect, the invention provides isolated native sequence PRO1599 polypeptide, which in one embodiment, includes an amino acid sequence comprising residues 31 to 283 of FIG. 64 (SEQ ID NO:111).

In another aspect, the invention concerns an isolated PRO1599 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 31 to about 283, inclusive of FIG. 64 (SEQ ID NO:111).

In a further aspect, the invention concerns an isolated PRO1599 polypeptide, comprising an amino acid sequence scoring at least about 80% positives, preferably at least about 85% positives, more preferably at least about 90% positives, most preferably at least about 95% positives when compared with the amino acid sequence of residues 31 to 283 of FIG. 64 (SEQ ID NO:111).

In yet another aspect, the invention concerns an isolated PRO1599 polypeptide, comprising the sequence of amino acid residues 31 to about 283, inclusive of FIG. 64 (SEQ ID NO:111), or a fragment thereof sufficient to provide a binding site for an anti-PRO1599 antibody. Preferably, the PRO1599 fragment retains a qualitative biological activity of a native PRO1599 polypeptide.

In a still further aspect, the invention provides a polypeptide produced by (i) hybridizing a test DNA molecule under stringent conditions with (a) a DNA molecule encoding a PRO1599 polypeptide having the sequence of amino acid residues from about 31 to about 283, inclusive of FIG. 64 (SEQ ID NO:111), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1599 polypeptide. In a particular embodiment, the agonist or antagonist is an anti-PRO1599 antibody.

In a further embodiment, the invention concerns a method of identifying agonists or antagonists of a native PRO1599 polypeptide, by contacting the native PRO1599 polypeptide with a candidate molecule and monitoring a biological activity mediated by said polypeptide.

In a still further embodiment, the invention concerns a composition comprising a PRO1599 polypeptide, or an agonist or antagonist as hereinabove defined, in combination with a pharmaceutically acceptable carrier.

33. PRO1430

A cDNA clone (DNA64842-1632) has been identified that encodes a novel polypeptide having homology to reductase proteins, designated in the present application as "PRO1430."

In one embodiment, the invention provides an isolated nucleic acid molecule comprising DNA encoding a PRO1430 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1430 polypeptide having the sequence of amino acid residues from 1 or about 18 to about 331, inclusive of FIG. 66 (SEQ ID NO:116), or (b) the complement of the DNA molecule of (a).

In another aspect, the invention concerns an isolated nucleic acid molecule encoding a PRO1430 polypeptide comprising DNA hybridizing to the complement of the nucleic acid between about residues 33 and about 1074, inclusive, of FIG. 65 (SEQ ID NO:115). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203278 (DNA64842-1632), or (b) the complement of the DNA molecule of (a). In a preferred embodiment, the nucleic acid comprises a DNA encoding the same mature polypeptide encoded by the human protein cDNA in ATCC Deposit No. 203278 (DNA64842-1632).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 331, inclusive of FIG. 66 (SEQ ID NO:116), or the complement of the DNA of (a).

In a further aspect, the invention concerns an isolated nucleic acid molecule having at least about 50 nucleotides, and preferably at least about 100 and produced by hybridizing a test DNA molecule under stringent conditions with (a) a DNA molecule encoding a PRO1430 polypeptide having the sequence of amino acid residues from about 18 to about 331, inclusive of FIG. 66 (SEQ ID NO:116), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1430 polypeptide, with or without the N-terminal signal sequence, or is complementary to such encoding nucleic acid molecule. The signal peptide has been tentatively identified as extending from amino acid position 1 through about amino acid position 17 in the sequence of FIG. 66 (SEQ ID NO:116).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 331, inclusive of FIG. 66 (SEQ ID NO:116), or (b) the complement of the DNA of (a).

Another embodiment is directed to fragments of a PRO1430 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1430 polypeptide encoded by any of the isolated nucleic acid sequences hereinabove defined.

In a specific aspect, the invention provides isolated native sequence PRO1430 polypeptide, which in one embodiment, includes an amino acid sequence comprising residues 18 to 331 of FIG. 66 (SEQ ID NO:116).

In another aspect, the invention concerns an isolated PRO1430 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 331, inclusive of FIG. 66 (SEQ ID NO:116).

In a further aspect, the invention concerns an isolated PRO1430 polypeptide, comprising an amino acid sequence scoring at least about 80% positives, preferably at least about 85% positives, more preferably at least about 90% positives, most preferably at least about 95% positives when compared with the amino acid sequence of residues 18 to 331 of FIG. 66 (SEQ ID NO:116).

In yet another aspect, the invention concerns an isolated PRO1430 polypeptide, comprising the sequence of amino acid residues 18 to about 331, inclusive of FIG. 66 (SEQ ID NO:116), or a fragment thereof sufficient to provide a binding site for an anti-PRO1430 antibody. Preferably, the PRO1430 fragment retains a qualitative biological activity of a native PRO1430 polypeptide.

In a still further aspect, the invention provides a polypeptide produced by (i) hybridizing a test DNA molecule under stringent conditions with (a) a DNA molecule encoding a PRO1430 polypeptide having the sequence of amino acid residues from about 18 to about 331, inclusive of FIG. 66 (SEQ ID NO:116), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1430 polypeptide. In a particular embodiment, the agonist or antagonist is an anti-PRO1430 antibody.

In a further embodiment, the invention concerns a method of identifying agonists or antagonists of a native PRO1430 polypeptide, by contacting the native PRO1430 polypeptide with a candidate molecule and monitoring a biological activity mediated by said polypeptide.

In a still further embodiment, the invention concerns a composition comprising a PRO1430 polypeptide, or an agonist or antagonist as hereinabove defined, in combination with a pharmaceutically acceptable carrier.

34. PRO1374

A cDNA clone (DNA64849-1604) has been identified that encodes a novel polypeptide having sequence identity with P4HA and designated in the present application as "PRO1374."

In one embodiment, the invention provides an isolated nucleic acid molecule comprising DNA encoding a PRO1374 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1374 polypeptide having the sequence of amino acid residues from 1 or about 20 to about 544, inclusive of FIG. 68 (SEQ ID NO:118), or (b) the complement of the DNA molecule of (a).

In another aspect, the invention concerns an isolated nucleic acid molecule encoding a PRO1374 polypeptide comprising DNA hybridizing to the complement of the nucleic acid between about residues 78 and about 1652, inclusive, of FIG. 67 (SEQ ID NO:117). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203468 (DNA64849-1604), or (b) the complement of the DNA molecule of (a). In a preferred embodiment, the nucleic acid comprises a DNA encoding the same mature polypeptide encoded by the human protein cDNA in ATCC Deposit No. 203468 (DNA64849-1604).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 544, inclusive of FIG. 68 (SEQ ID NO:118), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1374 polypeptide having the sequence of amino acid residues from about 20 to about 544, inclusive of FIG. 68 (SEQ ID NO:118), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 544, inclusive of FIG. 68 (SEQ ID NO:118), or (b) the complement of the DNA of (a).

Another embodiment is directed to fragments of a PRO1374 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1374 polypeptide encoded by any of the isolated nucleic acid sequences hereinabove defined.

In a specific aspect, the invention provides isolated native sequence PRO1374 polypeptide, which in one embodiment, includes an amino acid sequence comprising residues 20 through 544 of FIG. 68 (SEQ ID NO:118).

In another aspect, the invention concerns an isolated PRO1374 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 544, inclusive of FIG. 68 (SEQ ID NO:118).

In a further aspect, the invention concerns an isolated PRO1374 polypeptide, comprising an amino acid sequence scoring at least about 80% positives, preferably at least about 85% positives, more preferably at least about 90% positives, most preferably at least about 95% positives when compared with the amino acid sequence of residues 20 through 544 of FIG. 68 (SEQ ID NO:118).

In yet another aspect, the invention concerns an isolated PRO1374 polypeptide, comprising the sequence of amino acid residues 20 to about 544, inclusive of FIG. 68 (SEQ ID NO:118), or a fragment thereof sufficient to provide a binding site for an anti-PRO1374 antibody. Preferably, the PRO1374 fragment retains a qualitative biological activity of a native PRO1374 polypeptide.

In a still further aspect, the invention provides a polypeptide produced by (i) hybridizing a test DNA molecule under stringent conditions with (a) a DNA molecule encoding a PRO1374 polypeptide having the sequence of amino acid residues from about 20 to about 544, inclusive of FIG. 68 (SEQ ID NO:118), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1374 polypeptide. In a particular embodiment, the agonist or antagonist is an anti-PRO1374 antibody.

In a further embodiment, the invention concerns a method of identifying agonists or antagonists of a native PRO1374 polypeptide, by contacting the native PRO1374 polypeptide with a candidate molecule and monitoring a biological activity mediated by said polypeptide.

In a still further embodiment, the invention concerns a composition comprising a PRO1374 polypeptide, or an agonist or antagonist as hereinabove defined, in combination with a pharmaceutically acceptable carrier.

35. PRO1311

A cDNA clone (DNA64863-1573) has been identified that encodes a novel tetraspan polypeptide designated in the present application as "PRO1311."

In one embodiment, the invention provides an isolated nucleic acid molecule comprising DNA encoding a PRO1311 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1311 polypeptide having the sequence of amino acid residues from 1 or about 45 to about 294, inclusive of FIG. 70 (SEQ ID NO:123), or (b) the complement of the DNA molecule of (a).

In another aspect, the invention concerns an isolated nucleic acid molecule encoding a PRO1311 polypeptide comprising DNA hybridizing to the complement of the nucleic acid between about residues 327 and about 1076, inclusive, of FIG. 69 (SEQ ID NO:122). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203251 (DNA64863-1573), or (b) the complement of the DNA molecule of (a). In a preferred embodiment, the nucleic acid comprises a DNA encoding the same mature polypeptide encoded by the human protein cDNA in ATCC Deposit No. 203251 (DNA64863-1573).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 45 to about 294, inclusive of FIG. 70 (SEQ ID NO:123), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1311 polypeptide having the sequence of amino acid residues from about 45 to about 294, inclusive of FIG. 70 (SEQ ID NO:123), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1311 polypeptide, with or without the N-terminal signal sequence and/or the initiating methionine, and its soluble, i.e. transmembrane domains deleted or inactivated variants, or is complementary to such encoding nucleic acid molecule. The signal peptide has been tentatively identified as extending from amino acid position 1 through about amino acid position 44 in the sequence of FIG. 70 (SEQ ID NO:123). Four transmembrane domains has been tentatively identified as extending from about amino acid 2242, 57-85, 94-116, and 230-257 in the PRO1311 amino acid sequence (FIG. 70, SEQ ID NO:123).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 45 to about 294, inclusive of FIG. 70 (SEQ ID NO:123), or (b) the complement of the DNA of (a).

Another embodiment is directed to fragments of a PRO1311 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1311 polypeptide encoded by any of the isolated nucleic acid sequences hereinabove defined.

In a specific aspect, the invention provides isolated native sequence PRO1311 polypeptide, which in one embodiment, includes an amino acid sequence comprising residues 45 to 294 of FIG. 70 (SEQ ID NO:123).

In another aspect, the invention concerns an isolated PRO1311 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 45 to about 294, inclusive of FIG. 70 (SEQ ID NO:123).

In a further aspect, the invention concerns an isolated PRO1311 polypeptide, comprising an amino acid sequence scoring at least about 80% positives, preferably at least about 85% positives, more preferably at least about 90% positives, most preferably at least about 95% positives when compared with the amino acid sequence of residues 45 to 294 of FIG. 70 (SEQ ID NO:123).

In yet another aspect, the invention concerns an isolated PRO1311 polypeptide, comprising the sequence of amino acid residues 45 to about 294, inclusive of FIG. 70 (SEQ ID NO:123), or a fragment thereof sufficient to provide a binding site for an anti-PRO1311 antibody. Preferably, the PRO1311 fragment retains a qualitative biological activity of a native PRO1311 polypeptide.

In a still further aspect, the invention provides a polypeptide produced by (i) hybridizing a test DNA molecule under stringent conditions with (a) a DNA molecule encoding a PRO1311 polypeptide having the sequence of amino acid residues from about 45 to about 294, inclusive of FIG. 70 (SEQ ID NO:123), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

36. PRO1357

A cDNA clone (DNA64881-1602) has been identified, having homology to nucleic acid encoding the von Ebner minor salivary gland protein that encodes a novel polypeptide, designated in the present application as "PRO1357".

In one embodiment, the invention provides an isolated nucleic acid molecule comprising DNA encoding a PRO1357 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1357 polypeptide having the sequence of amino acid residues from about 1 or about 22 to about 484, inclusive of FIG. 72 (SEQ ID NO:128), or (b) the complement of the DNA molecule of (a).

In another aspect, the invention concerns an isolated nucleic acid molecule encoding a PRO1357 polypeptide comprising DNA hybridizing to the complement of the nucleic acid between about nucleotides 74 or about 137 and about 1525, inclusive, of FIG. 71 (SEQ ID NO:127). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203240 (DNA64881-1602) or (b) the complement of the nucleic acid molecule of (a). In a preferred embodiment, the nucleic acid comprises a DNA encoding the same mature polypeptide encoded by the human protein cDNA in ATCC Deposit No. 203240 (DNA64881-1602).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 22 to about 484, inclusive of FIG. 72 (SEQ ID NO:128), or (b) the complement of the DNA of (a).

In a further aspect, the invention concerns an isolated nucleic acid molecule having at least 40 nucleotides and produced by hybridizing a test DNA molecule under stringent conditions with (a) a DNA molecule encoding a PRO1357 polypeptide having the sequence of amino acid residues from 1 or about 22 to about 484, inclusive of FIG. 72 (SEQ ID NO:128), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1357 polypeptide, with or without the N-terminal signal sequence and/or the initiating methionine, or is complementary to such encoding nucleic acid molecule. The signal peptide has been tentatively identified as extending from about amino acid position 1 to about amino acid position 21 in the sequence of FIG. 72 (SEQ ID NO:128).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 22 to about 484, inclusive of FIG. 72 (SEQ ID NO:128), or (b) the complement of the DNA of (a).

Another embodiment is directed to fragments of a PRO1357 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 71 (SEQ ID NO:127).

In another embodiment, the invention provides isolated PRO1357 polypeptide encoded by any of the isolated nucleic acid sequences hereinabove identified.

In a specific aspect, the invention provides isolated native sequence PRO1357 polypeptide, which in certain embodiments, includes an amino acid sequence comprising residues 1 or about 22 to about 484 of FIG. 72 (SEQ ID NO:128).

In another aspect, the invention concerns an isolated PRO1357 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 22 to about 484, inclusive of FIG. 72 (SEQ ID NO:128).

In a further aspect, the invention concerns an isolated PRO1357 polypeptide, comprising an amino acid sequence scoring at least about 80% positives, preferably at least about 85% positives, more preferably at least about 90% positives, most preferably at least about 95% positives when compared with the amino acid sequence of residues 1 or about 22 to about 484, inclusive of FIG. 72 (SEQ ID NO:128).

In yet another aspect, the invention concerns an isolated PRO1357 polypeptide, comprising the sequence of amino acid residues 1 or about 22 to about 484, inclusive of FIG. 72 (SEQ ID NO:128), or a fragment thereof sufficient to provide a binding site for an anti-PRO1357 antibody. Preferably, the PRO1357 fragment retains a qualitative biological activity of a native PRO1357 polypeptide.

In a still further aspect, the invention provides a polypeptide produced by (i) hybridizing a test DNA molecule under stringent conditions with (a) a DNA molecule encoding a PRO1357 polypeptide having the sequence of amino acid residues from about 1 or about 22 to about 484, inclusive of FIG. 72 (SEQ ID NO:128), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1357 polypeptide. In a particular embodiment, the agonist or antagonist is an anti-PRO1357 antibody.

In a further embodiment, the invention concerns a method of identifying agonists or antagonists of a native PRO1357 polypeptide by contacting the native PRO1357 polypeptide with a candidate molecule and monitoring a biological activity mediated by said polypeptide.

In a still further embodiment, the invention concerns a composition comprising a PRO1357 polypeptide, or an agonist or antagonist as hereinabove defined, in combination with a pharmaceutically acceptable carrier.

37. PRO1244

A cDNA clone (DNA64883-1526) has been identified that encodes a novel polypeptide having homology to Implantation-Associated Protein and designated in the present application as "PRO1244."

In one embodiment, the invention provides an isolated nucleic acid molecule comprising DNA encoding a PRO1244 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1244 polypeptide having the sequence of amino acid residues from 1 or about 30 to about 335, inclusive of FIG. 74 (SEQ ID NO:130), or (b) the complement of the DNA molecule of (a).

In another aspect, the invention concerns an isolated nucleic acid molecule encoding a PRO1244 polypeptide comprising DNA hybridizing to the complement of the nucleic acid between about residues 96 and about 1013, inclusive, of FIG. 73 (SEQ ID NO:129). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203253 (DNA64883-1526), or (b) the complement of the DNA molecule of (a). In a preferred embodiment, the nucleic acid comprises a DNA encoding the same mature polypeptide encoded by the human protein cDNA in ATCC Deposit No. 203253 (DNA64883-1526).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 30 to about 335, inclusive of FIG. 74 (SEQ ID NO:130), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1244 polypeptide having the sequence of amino acid residues from about 30 to about 335, inclusive of FIG. 74 (SEQ ID NO:130), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1244 polypeptide, with or without the N-terminal signal sequence and/or the initiating methionine, and its soluble, i.e. transmembrane domains deleted or inactivated variants, or is complementary to such encoding nucleic acid molecule. The signal peptide has been tentatively identified as extending from amino acid position 1 through about amino acid position 29 in the sequence of FIG. 74 (SEQ ID NO:130). The transmembrane domains have been tentatively identified in the PRO1244 amino acid sequence at about the following amino acid regions: 183–205, 217–137, 271–287, and 301–321.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 30 to about 335, inclusive of FIG. 74 (SEQ ID NO:130), or (b) the complement of the DNA of (a).

Another embodiment is directed to fragments of a PRO1244 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1244 polypeptide encoded by any of the isolated nucleic acid sequences hereinabove defined.

In a specific aspect, the invention provides isolated native sequence PRO1244 polypeptide, which in one embodiment, includes an amino acid sequence comprising residues 30 to 335 of FIG. 74 (SEQ ID NO:130).

In another aspect, the invention concerns an isolated PRO1244 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 30 to about 335, inclusive of FIG. 74 (SEQ ID NO:130).

In a further aspect, the invention concerns an isolated PRO1244 polypeptide, comprising an amino acid sequence scoring at least about 80% positives, preferably at least about 85% positives, more preferably at least about 90% positives, most preferably at least about 95% positives when compared with the amino acid sequence of residues 30 to 335 of FIG. 74 (SEQ ID NO:130).

In a still further aspect, the invention provides a polypeptide produced by (i) hybridizing a test DNA molecule under stringent conditions with (a) a DNA molecule encoding a PRO1244 polypeptide having the sequence of amino acid residues from about 30 to about 335, inclusive of FIG. 74 (SEQ ID NO:130), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1244 polypeptide. In a particular embodiment, the agonist or antagonist is an anti-PRO1244 antibody.

In a further embodiment, the invention concerns a method of identifying agonists or antagonists of a native PRO1244 polypeptide, by contacting the native PRO1244 polypeptide with a candidate molecule and monitoring a biological activity mediated by said polypeptide.

In a still further embodiment, the invention concerns a composition comprising a PRO1244 polypeptide, or an agonist or antagonist as hereinabove defined, in combination with a pharmaceutically acceptable carrier.

38. PRO1246

A cDNA clone (DNA64885-1529) has been identified, having homology to nucleic acid encoding bone-related sulphatase that encodes a novel polypeptide, designated in the present application as "PRO1246".

In one embodiment, the invention provides an isolated nucleic acid molecule comprising DNA encoding a PRO1246 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1246 polypeptide having the sequence of amino acid residues from about 1 or about 16 to about 536, inclusive of FIG. 76 (SEQ ID NO:132), or (b) the complement of the DNA molecule of (a).

In another aspect, the invention concerns an isolated nucleic acid molecule encoding a PRO1246 polypeptide comprising DNA hybridizing to the complement of the nucleic acid between about nucleotides 119 or about 164 and about 1726, inclusive, of FIG. 75 (SEQ ID NO:131). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203457 (DNA64885-1529) or (b) the complement of the nucleic acid molecule of (a). In a preferred embodiment, the nucleic acid comprises a DNA encoding the same mature polypeptide encoded by the human protein cDNA in ATCC Deposit No. 203457 (DNA64885-1529).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 536, inclusive of FIG. 76 (SEQ ID NO:132), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1246 polypeptide having the sequence of amino acid residues from 1 or about 16 to about 536, inclusive of FIG. 76 (SEQ ID NO:132), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1246 polypeptide, with or without the N-terminal signal sequence and/or the initiating methionine, or is complementary to such encoding nucleic acid molecule. The signal peptide has been tentatively identified as extending from about amino acid position 1 to about amino acid position 16 in the sequence of FIG. 76 (SEQ ID NO:132).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 536, inclusive of FIG. 76 (SEQ ID NO:132), or (b) the complement of the DNA of (a).

Another embodiment is directed to fragments of a PRO1246 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 75 (SEQ ID NO:131).

In another embodiment, the invention provides isolated PRO1246 polypeptide encoded by any of the isolated nucleic acid sequences hereinabove identified.

In a specific aspect, the invention provides isolated native sequence PRO1246 polypeptide, which in certain embodiments, includes an amino acid sequence comprising residues 1 or about 16 to about 536 of FIG. 76 (SEQ ID NO:132).

In another aspect, the invention concerns an isolated PRO1246 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 536, inclusive of FIG. 76 (SEQ ID NO:132).

In a further aspect, the invention concerns an isolated PRO1246 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 536, inclusive of FIG. 76 (SEQ ID NO:132).

In yet another aspect, the invention concerns an isolated PRO1246 polypeptide, comprising the sequence of amino acid residues 1 or about 16 to about 536, inclusive of FIG. 76 (SEQ ID NO:132), or a fragment thereof sufficient to provide a binding site for an anti-PRO1246 antibody. Preferably, the PRO1246 fragment retains a qualitative biological activity of a native PRO1246 polypeptide.

In a still further aspect, the invention provides a polypeptide produced by (i) hybridizing a test DNA molecule under stringent conditions with (a) a DNA molecule encoding a PRO1246 polypeptide having the sequence of amino acid residues from about 1 or about 16 to about 536, inclusive of FIG. 76 (SEQ ID NO:132), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1246 polypeptide. In a particular embodiment, the agonist or antagonist is an anti-PRO1246 antibody.

In a further embodiment, the invention concerns a method of identifying agonists or antagonists of a native PRO1246 polypeptide by contacting the native PRO1246 polypeptide with a candidate molecule and monitoring a biological activity mediated by said polypeptide.

In a still further embodiment, the invention concerns a composition comprising a PRO1246 polypeptide, or an agonist or antagonist as hereinabove defined, in combination with a pharmaceutically acceptable carrier.

39. PRO1356

A cDNA clone (DNA64886-1601) has been identified, having homology to nucleic acid encoding clostridium perfringens enterotoxin receptor, that encodes a novel polypeptide, designated in the present application as "PRO1356".

In one embodiment, the invention provides an isolated nucleic acid molecule comprising DNA encoding a PRO1356 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1356 polypeptide having the sequence of amino acid residues from about 1 or about 25 to about 230, inclusive of FIG. 78 (SEQ ID NO:134), or (b) the complement of the DNA molecule of (a).

In another aspect, the invention concerns an isolated nucleic acid molecule encoding a PRO1356 polypeptide comprising DNA hybridizing to the complement of the nucleic acid between about nucleotides 122 or about 194 and about 811, inclusive, of FIG. 77 (SEQ ID NO:133). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203241 (DNA64886-1601) or (b) the complement of the nucleic acid molecule of (a). In a preferred embodiment, the nucleic acid comprises a DNA encoding the same mature polypeptide encoded by the human protein cDNA in ATCC Deposit No. 203241 (DNA64886-1601).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 25 to about 230, inclusive of FIG. 78 (SEQ ID NO:134), or (b) the complement of the DNA of (a).

In a further aspect, the invention concerns an isolated nucleic acid molecule having at least 20 nucleotides and produced by hybridizing a test DNA molecule under stringent conditions with (a) a DNA molecule encoding a PRO1356 polypeptide having the sequence of amino acid residues from 1 or about 25 to about 230, inclusive of FIG. 78 (SEQ ID NO:134), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1356 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 24 in the sequence of FIG. 78 (SEQ ID NO:134). The transmembrane domains have been tentatively identified as extending from about amino acid position 82 to about amino acid position 102, from about amino acid position 117 to about amino acid position 140 and from about amino acid position 163 to about amino acid position 182 in the PRO1356 amino acid sequence (FIG. 78, SEQ ID NO:134).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 25 to about 230, inclusive of FIG. 78 (SEQ ID NO:134), or (b) the complement of the DNA of (a).

Another embodiment is directed to fragments of a PRO1356 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 77 (SEQ ID NO:133).

In another embodiment, the invention provides isolated PRO1356 polypeptide encoded by any of the isolated nucleic acid sequences hereinabove identified.

In a specific aspect, the invention provides isolated native sequence PRO1356 polypeptide, which in certain embodiments, includes an amino acid sequence comprising residues 1 or about 25 to about 230 of FIG. 78 (SEQ ID NO:134).

In another aspect, the invention concerns an isolated PRO1356 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 25 to about 230, inclusive of FIG. 78 (SEQ ID NO:134).

In a further aspect, the invention concerns an isolated PRO1356 polypeptide, comprising an amino acid sequence scoring at least about 80% positives, preferably at least about 85% positives, more preferably at least about 90% positives, most preferably at least about 95% positives when compared with the amino acid sequence of residues 1 or about 25 to about 230, inclusive of FIG. 78 (SEQ ID NO:134).

In yet another aspect, the invention concerns an isolated PRO1356 polypeptide, comprising the sequence of amino acid residues 1 or about 25 to about 230, inclusive of FIG. 78 (SEQ ID NO:134), or a fragment thereof sufficient to provide a binding site for an anti-PRO1356 antibody. Preferably, the PRO1356 fragment retains a qualitative biological activity of a native PRO1356 polypeptide.

In a still further aspect, the invention provides a polypeptide produced by (i) hybridizing a test DNA molecule under stringent conditions with (a) a DNA molecule encoding a PRO1356 polypeptide having the sequence of amino acid residues from about 1 or about 25 to about 230, inclusive of FIG. 78 (SEQ ID NO:134), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1356 polypeptide. In a particular embodiment, the agonist or antagonist is an anti-PRO1356 antibody.

In a further embodiment, the invention concerns a method of identifying agonists or antagonists of a native PRO1356 polypeptide by contacting the native PRO1356 polypeptide with a candidate molecule and monitoring a biological activity mediated by said polypeptide.

In a still further embodiment, the invention concerns a composition comprising a PRO1356polypeptide, or an agonist or antagonist as hereinabove defined, in combination with a pharmaceutically acceptable carrier.

40. PRO1275

A cDNA clone (DNA64888-1542) has been identified that encodes a novel secreted polypeptide designated in the present application as "PRO1275."

In one embodiment, the invention provides an isolated nucleic acid molecule comprising DNA encoding a PRO1275 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1275 polypeptide having the sequence of amino acid residues from about 26 to about 119, inclusive of FIG. 80 (SEQ ID NO:136), or (b) the complement of the DNA molecule of (a).

In another aspect, the invention concerns an isolated nucleic acid molecule encoding a PRO1275 polypeptide comprising DNA hybridizing to the complement of the nucleic acid between about residues 112 and about 393, inclusive, of FIG. 79 (SEQ ID NO:135). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203249 (DNA64888-1542), or (b) the complement of the DNA molecule of (a). In a preferred embodiment, the nucleic acid comprises a DNA encoding the same mature polypeptide encoded by the human protein cDNA in ATCC Deposit No. 203249 (DNA64888-1542).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 26 to about 119, inclusive of FIG. 80 (SEQ ID NO:136), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1275 polypeptide having the sequence of amino acid residues from about 26 to about 119, inclusive of FIG. 80 (SEQ ID NO:136), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 26 to about 119, inclusive of FIG. 80 (SEQ ID NO:136), or (b) the complement of the DNA of (a).

Another embodiment is directed to fragments of a PRO1275 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1275 polypeptide encoded by any of the isolated nucleic acid sequences hereinabove defined.

In a specific aspect, the invention provides isolated native sequence PRO1275 polypeptide, which in one embodiment, includes an amino acid sequence comprising residues 26 through 119 of FIG. 80 (SEQ ID NO:136).

In another aspect, the invention concerns an isolated PRO1275 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 26 to about 119, inclusive of FIG. 80 (SEQ ID NO:136).

In a further aspect, the invention concerns an isolated PRO1275 polypeptide, comprising an amino acid sequence scoring at least about 80% positives, preferably at least about 85% positives, more preferably at least about 90% positives, most preferably at least about 95% positives when compared with the amino acid sequence of residues 26 through 119 of FIG. 80 (SEQ ID NO:136).

In yet another aspect, the invention concerns an isolated PRO1275 polypeptide, comprising the sequence of amino acid residues 26 to about 119, inclusive of FIG. 80 (SEQ ID NO:136), or a fragment thereof sufficient to provide a binding site for an anti-PRO1275 antibody. Preferably, the PRO1275 fragment retains a qualitative biological activity of a native PRO1275 polypeptide.

In a still further aspect, the invention provides a polypeptide produced by (i) hybridizing a test DNA molecule under stringent conditions with (a) a DNA molecule encoding a PRO1275 polypeptide having the sequence of amino acid residues from about 26 to about 119, inclusive of FIG. 80 (SEQ ID NO:136), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1275 polypeptide. In a particular embodiment, the agonist or antagonist is an anti-PRO1275 antibody.

In a further embodiment, the invention concerns a method of identifying agonists or antagonists of a native PRO1275 polypeptide, by contacting the native PRO1275 polypeptide with a candidate molecule and monitoring a biological activity mediated by said polypeptide.

In a still further embodiment, the invention concerns a composition comprising a PRO1275 polypeptide, or an agonist or antagonist as hereinabove defined, in combination with a pharmaceutically acceptable carrier.

41. PRO1274

A cDNA clone (DNA64889-1541) has been identified that encodes a novel secreted polypeptide designated in the present application as "PRO1274."

In one embodiment, the invention provides an isolated nucleic acid molecule comprising DNA encoding a PRO1274 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1274 polypeptide having the sequence of amino acid residues from 1 or about 25 to about 110, inclusive of FIG. 82 (SEQ ID NO:138), or (b) the complement of the DNA molecule of (a).

In another aspect, the invention concerns an isolated nucleic acid molecule encoding a PRO1274 polypeptide comprising DNA hybridizing to the complement of the nucleic acid between about residues 96 and about 353, inclusive, of FIG. 81 (SEQ ID NO:137). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203250 (DNA64889-1541), or (b) the complement of the DNA molecule of (a). In a preferred embodiment, the nucleic acid comprises a DNA encoding the same mature polypeptide encoded by the human protein cDNA in ATCC Deposit No. 203250 (DNA64889-1541).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 25 to about 110, inclusive of FIG. 82 (SEQ ID NO:138), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1274 polypeptide having the sequence of amino acid residues from about 25 to about 110, inclusive of FIG. 82 (SEQ ID NO:138), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 25 to about 110, inclusive of FIG. 82 (SEQ ID NO:138), or (b) the complement of the DNA of (a).

Another embodiment is directed to fragments of a PRO1274 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1274 polypeptide encoded by any of the isolated nucleic acid sequences hereinabove defined.

In a specific aspect, the invention provides isolated native sequence PRO1274 polypeptide, which in one embodiment, includes an amino acid sequence comprising residues 25 through 110 of FIG. 82 (SEQ ID NO:138).

In another aspect, the invention concerns an isolated PRO1274 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 25 to about 110, inclusive of FIG. 82 (SEQ ID NO:138).

In a further aspect, the invention concerns an isolated PRO1274 polypeptide, comprising an amino acid sequence scoring at least about 80% positives, preferably at least about 85% positives, more preferably at least about 90% positives, most preferably at least about 95% positives when compared with the amino acid sequence of residues 25 through 110 of FIG. 82 (SEQ ID NO:138).

In yet another aspect, the invention concerns an isolated PRO1274 polypeptide, comprising the sequence of amino acid residues 25 to about 110, inclusive of FIG. 82 (SEQ ID NO:138), or a fragment thereof sufficient to provide a binding site for an anti-PRO1274 antibody. Preferably, the PRO1274 fragment retains a qualitative biological activity of a native PRO1274 polypeptide.

In a still further aspect, the invention provides a polypeptide produced by (i) hybridizing a test DNA molecule under stringent conditions with (a) a DNA molecule encoding a PRO1274 polypeptide having the sequence of amino acid residues from about 25 to about 110, inclusive of FIG. 82 (SEQ ID NO:138), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1274 polypeptide. In a particular embodiment, the agonist or antagonist is an anti-PRO1274 antibody.

In a further embodiment, the invention concerns a method of identifying agonists or antagonists of a native PRO1274 polypeptide, by contacting the native PRO1274 polypeptide with a candidate molecule and monitoring a biological activity mediated by said polypeptide.

In a still further embodiment, the invention concerns a composition comprising a PRO1274 polypeptide, or an agonist or antagonist as hereinabove defined, in combination with a pharmaceutically acceptable carrier.

42. PRO1412

A cDNA clone (DNA64897-1628) has been identified that encodes a novel transmembrane polypeptide designated in the present application as "PRO1412."

In one embodiment, the invention provides an isolated nucleic acid molecule comprising DNA encoding a PRO1412 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1412 polypeptide having the sequence of amino acid residues from 1 or about 29 to about 311, inclusive of FIG. 84 (SEQ ID NO:140), or (b) the complement of the DNA molecule of (a).

In another aspect, the invention concerns an isolated nucleic acid molecule encoding a PRO1412 polypeptide comprising DNA hybridizing to the complement of the nucleic acid between about residues 226 and about 1074, inclusive, of FIG. 83 (SEQ ID NO:139). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203216 (DNA64897-1628), or (b) the complement of the DNA molecule of (a). In a preferred embodiment, the nucleic acid comprises a DNA encoding the same mature polypeptide encoded by the human protein cDNA in ATCC Deposit No. 203216 (DNA64897-1628).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 29 to about 311, inclusive of FIG. 84 (SEQ ID NO:140), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1412 polypeptide having the sequence of amino acid residues from about 29 to about 311, inclusive of FIG. 84 (SEQ ID NO:140), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1412 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 28 in the sequence of FIG. 84 (SEQ ID NO:140). The transmembrane domain has been tentatively identified as extending from about amino acid position 190 through about amino acid position 216 in the PRO1412 amino acid sequence (FIG. 84, SEQ ID NO:140).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 29 to about 311, inclusive of FIG. 84 (SEQ ID NO:140), or (b) the complement of the DNA of (a).

Another embodiment is directed to fragments of a PRO1412 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1412 polypeptide encoded by any of the isolated nucleic acid sequences hereinabove defined.

In a specific aspect, the invention provides isolated native sequence PRO1412 polypeptide, which in one embodiment, includes an amino acid sequence comprising residues 29 to 311 of FIG. 84 (SEQ ID NO:140).

In another aspect, the invention concerns an isolated PRO1412 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 29 to about 311, inclusive of FIG. 84 (SEQ ID NO:140).

In a further aspect, the invention concerns an isolated PRO1412 polypeptide, comprising an amino acid sequence scoring at least about 80% positives, preferably at least about 85% positives, more preferably at least about 90% positives, most preferably at least about 95% positives when compared with the amino acid sequence of residues 29 to 311 of FIG. 84 (SEQ ID NO:140).

In yet another aspect, the invention concerns an isolated PRO1412 polypeptide, comprising the sequence of amino acid residues 29 to about 311, inclusive of FIG. 84 (SEQ ID NO:140), or a fragment thereof sufficient to provide a binding site for an anti-PRO1412 antibody. Preferably, the PRO1412 fragment retains a qualitative biological activity of a native PRO1412 polypeptide.

In a still further aspect, the invention provides a polypeptide produced by (i) hybridizing a test DNA molecule under stringent conditions with (a) a DNA molecule encoding a PRO1412 polypeptide having the sequence of amino acid residues from about 29 to about 311, inclusive of FIG. 84 (SEQ ID NO:140), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

43. PRO1557

A cDNA clone (DNA64902-1667) has been identified that encodes a novel polypeptide having homology to chordin and designated in the present application as "PRO1557".

In one embodiment, the invention provides an isolated nucleic acid molecule comprising DNA encoding a PRO1557 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1557 polypeptide having the sequence of amino acid residues from 1 or about 26 to about 451, inclusive of FIG. 86 (SEQ ID NO:142), or (b) the complement of the DNA molecule of (a).

In another aspect, the invention concerns an isolated nucleic acid molecule encoding a PRO1557 polypeptide comprising DNA hybridizing to the complement of the nucleic acid between about residues 362 and about 1639, inclusive, of FIG. 85 (SEQ ID NO:141). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203317 (DNA64902-1667), or (b) the complement of the DNA molecule of (a). In a preferred embodiment, the nucleic acid comprises a DNA encoding the same mature polypeptide encoded by the human protein cDNA in ATCC Deposit No. 203317 (DNA64902-1667).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 26 to about 451, inclusive of FIG. 86 (SEQ ID NO:142), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1557 polypeptide having the sequence of amino acid residues from about 26 to about 451, inclusive of FIG. 86 (SEQ ID NO:142), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1557 polypeptide, with or without the N-terminal signal sequence, or is complementary to such encoding nucleic acid molecule. The signal peptide has been tentatively identified as extending from amino acid position 1 through about amino acid position 25 in the sequence of FIG. 86 (SEQ ID NO:142).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 26 to about 451, inclusive of FIG. 86 (SEQ ID NO:142), or (b) the complement of the DNA of (a).

Another embodiment is directed to fragments of a PRO1557 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1557 polypeptide encoded by any of the isolated nucleic acid sequences hereinabove defined.

In a specific aspect, the invention provides isolated native sequence PRO1557 polypeptide, which in one embodiment, includes an amino acid sequence comprising residues 26 to 451 of FIG. 86 (SEQ ID NO:142).

In another aspect, the invention concerns an isolated PRO1557 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 26 to about 451, inclusive of FIG. 86 (SEQ ID NO:142).

In a further aspect, the invention concerns an isolated PRO1557 polypeptide, comprising an amino acid sequence scoring at least about 80% positives, preferably at least about 85% positives, more preferably at least about 90% positives, most preferably at least about 95% positives when compared with the amino acid sequence of residues 26 to 451 of FIG. 86 (SEQ ID NO:142).

In yet another aspect, the invention concerns an isolated PRO1557 polypeptide, comprising the sequence of amino acid residues 26 to about 451, inclusive of FIG. 86 (SEQ ID NO:142), or a fragment thereof sufficient to provide a binding site for an anti-PRO1557 antibody. Preferably, the PRO1557 fragment retains a qualitative biological activity of a native PRO1557 polypeptide.

In a still further aspect, the invention provides a polypeptide produced by (i) hybridizing a test DNA molecule under stringent conditions with (a) a DNA molecule encoding a PRO1557 polypeptide having the sequence of amino acid residues from about 26 to about 451, inclusive of FIG. 86 (SEQ ID NO:142), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1557 polypeptide. In a particular embodiment, the agonist or antagonist is an anti-PRO1557 antibody.

In a further embodiment, the invention concerns a method of identifying agonists or antagonists of a native PRO1557 polypeptide by contacting the native PRO1557 polypeptide with a candidate molecule and monitoring a biological activity mediated by said polypeptide.

In a still further embodiment, the invention concerns a composition comprising a PRO1557 polypeptide, or an agonist or antagonist as hereinabove defined, in combination with a pharmaceutically acceptable carrier.

44. PRO1286

A cDNA clone (DNA64903-1553) has been identified that encodes a novel secreted polypeptide that is designated in the present application as "PRO1286."

In one embodiment, the invention provides an isolated nucleic acid molecule comprising DNA encoding a PRO1286 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1286 polypeptide having the sequence of amino acid residues from 1 or about 19 to about 93, inclusive of FIG. 88 (SEQ ID NO:144), or (b) the complement of the DNA molecule of (a).

In another aspect, the invention concerns an isolated nucleic acid molecule encoding a PRO1286 polypeptide comprising DNA hybridizing to the complement of the nucleic acid between about residues 147 and about 371, inclusive, of FIG. 87 (SEQ ID NO:143). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203223 (DNA64903-1553), or (b) the complement of the DNA molecule of (a). In a preferred embodiment, the nucleic acid comprises a DNA encoding the same mature polypeptide encoded by the human protein cDNA in ATCC Deposit No. 203223 (DNA64903-1553).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 93, inclusive of FIG. 88 (SEQ ID NO:144), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1286 polypeptide having the sequence of amino acid residues from about 19 to about 93, inclusive of FIG. 88 (SEQ ID NO:144), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1286 polypeptide, with or without the N-terminal signal sequence and/or the initiating methionine, or is complementary to such encoding nucleic acid molecule. The signal peptide has been tentatively identified as extending from amino acid position 1 through about amino acid position 18 in the sequence of FIG. 88 (SEQ ID NO:144).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 93, inclusive of FIG. 88 (SEQ ID NO:144), or (b) the complement of the DNA of (a).

Another embodiment is directed to fragments of a PRO1286 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1286 polypeptide encoded by any of the isolated nucleic acid sequences hereinabove defined.

In a specific aspect, the invention provides isolated native sequence PRO1286 polypeptide, which in one embodiment, includes an amino acid sequence comprising residues 19 to 93 of FIG. 88 (SEQ ID NO:144).

In another aspect, the invention concerns an isolated PRO1286 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 93, inclusive of FIG. 88 (SEQ ID NO:144).

In a further aspect, the invention concerns an isolated PRO1286 polypeptide, comprising an amino acid sequence scoring at least about 80% positives, preferably at least about 85% positives, more preferably at least about 90% positives, most preferably at least about 95% positives when compared with the amino acid sequence of residues 19 to 93 of FIG. 88 (SEQ ID NO:144).

In yet another aspect, the invention concerns an isolated PRO1286 polypeptide, comprising the sequence of amino acid residues 19 to about 93, inclusive of FIG. 88 (SEQ ID NO:144), or a fragment thereof sufficient to provide a binding site for an anti-PRO1286 antibody. Preferably, the PRO1286 fragment retains a qualitative biological activity of a native PRO1286 polypeptide.

In a still further aspect, the invention provides a polypeptide produced by (i) hybridizing a test DNA molecule under stringent conditions with (a) a DNA molecule encoding a PRO1286 polypeptide having the sequence of amino acid residues from about 19 to about 93, inclusive of FIG. 88 (SEQ ID NO:144), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

45. PRO1294

A cDNA clone (DNA64905-1558) has been identified, having homology to nucleic acid encoding olfactomedin, that encodes a novel polypeptide, designated in the present application as "PRO1294".

In one embodiment, the invention provides an isolated nucleic acid molecule comprising DNA encoding a PRO1294 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1294 polypeptide having the sequence of amino acid residues from about 1 or about 22 to about 406, inclusive of FIG. 90 (SEQ ID NO:146), or (b) the complement of the DNA molecule of (a).

In another aspect, the invention concerns an isolated nucleic acid molecule encoding a PRO1294 polypeptide comprising DNA hybridizing to the complement of the nucleic acid between about nucleotides 110 or about 173 and about 1327, inclusive, of FIG. 89 (SEQ ID NO:145). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203233 (DNA64905-1558) or (b) the complement of the nucleic acid molecule of (a). In a preferred embodiment, the nucleic acid comprises a DNA encoding the same mature polypeptide encoded by the human protein cDNA in ATCC Deposit No. 203233 (DNA64905-1558).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 22 to about 406, inclusive of FIG. 90 (SEQ ID NO:146), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1294 polypeptide having the sequence of amino acid residues from 1 or about 22 to about 406, inclusive of FIG. 90 (SEQ ID NO:146), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1294 polypeptide, with or without the N-terminal signal sequence and/or the initiating methionine, or is complementary to such encoding nucleic acid molecule. The signal peptide has been tentatively identified as extending from about amino acid position 1 to about amino acid position 21 in the sequence of FIG. 90 (SEQ ID NO:146).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 22 to about 406, inclusive of FIG. 90 (SEQ ID NO:146), or (b) the complement of the DNA of (a).

Another embodiment is directed to fragments of a PRO1294 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 89 (SEQ ID NO:145).

In another embodiment, the invention provides isolated PRO1294 polypeptide encoded by any of the isolated nucleic acid sequences hereinabove identified.

In a specific aspect, the invention provides isolated native sequence PRO1294 polypeptide, which in certain embodiments, includes an amino acid sequence comprising residues 1 or about 22 to about 406 of FIG. 90 (SEQ ID NO:146).

In another aspect, the invention concerns an isolated PRO1294 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 22 to about 406, inclusive of FIG. 90 (SEQ ID NO:146).

In a further aspect, the invention concerns an isolated PRO1294 polypeptide, comprising an amino acid sequence scoring at least about 80% positives, preferably at least about 85% positives, more preferably at least about 90% positives, most preferably at least about 95% positives when compared with the amino acid sequence of residues 1 or about 22 to about 406, inclusive of FIG. 90 (SEQ ID NO:146).

In yet another aspect, the invention concerns an isolated PRO1294 polypeptide, comprising the sequence of amino acid residues 1 or about 22 to about 406, inclusive of FIG. 90 (SEQ ID NO:146), or a fragment thereof sufficient to provide a binding site for an anti-PRO1294 antibody. Preferably, the PRO1294 fragment retains a qualitative biological activity of a native PRO1294 polypeptide.

In a still further aspect, the invention provides a polypeptide produced by (i) hybridizing a test DNA molecule under stringent conditions with (a) a DNA molecule encoding a PRO1294 polypeptide having the sequence of amino acid residues from about 1 or about 22 to about 406, inclusive of FIG. 90 (SEQ ID NO:146), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1294 polypeptide. In a particular embodiment, the agonist or antagonist is an anti-PRO1294 antibody.

In a further embodiment, the invention concerns a method of identifying agonists or antagonists of a native PRO1294 polypeptide by contacting the native PRO1294 polypeptide with a candidate molecule and monitoring a biological activity mediated by said polypeptide.

In a still further embodiment, the invention concerns a composition comprising a PRO1294 polypeptide, or an agonist or antagonist as hereinabove defined, in combination with a pharmaceutically acceptable carrier.

46. PRO1347

A cDNA clone (DNA64950-1590) has been identified that encodes a novel polypeptide having sequence identity with butyrophilin and designated in the present application as "PRO1347."

In one embodiment, the invention provides an isolated nucleic acid molecule comprising DNA encoding a PRO1347 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1347 polypeptide having the sequence of amino acid residues from 1 or about 18 to about 500, inclusive of FIG. 92 (SEQ ID NO:148), or (b) the complement of the DNA molecule of (a).

In another aspect, the invention concerns an isolated nucleic acid molecule encoding a PRO1347 polypeptide comprising DNA hybridizing to the complement of the nucleic acid between about residues 234 and about 1682, inclusive, of FIG. 91 (SEQ ID NO:147). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203224 (DNA64950-1590), or (b) the complement of the DNA molecule of (a). In a preferred embodiment, the nucleic acid comprises a DNA encoding the same mature polypeptide encoded by the human protein cDNA in ATCC Deposit No. 203224 (DNA64950-1590).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 500, inclusive of FIG. 92 (SEQ ID NO:148), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1347 polypeptide having the sequence of amino acid residues from about 18 to about 500, inclusive of FIG. 92 (SEQ ID NO:148), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1347 polypeptide, with or without the N-terminal signal sequence and/or the initiating methionine, and its soluble, i.e. transmembrane domain deleted (or that terminus truncated) or inactivated variants, or is complementary to such encoding nucleic acid molecule. The signal peptide has been tentatively identified as extending from amino acid position 1 through about amino acid position 17 in the sequence of FIG. 92 (SEQ ID NO:148). The transmembrane domain has been tentatively identified as extending from about amino acid position 239 through about amino acid position 255 in the PRO1347 amino acid sequence (FIG. 92, SEQ ID NO:148).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 500, inclusive of FIG. 92 (SEQ ID NO:148), or (b) the complement of the DNA of (a).

Another embodiment is directed to fragments of a PRO1347 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1347 polypeptide encoded by any of the isolated nucleic acid sequences hereinabove defined.

In a specific aspect, the invention provides isolated native sequence PRO1347 polypeptide, which in one embodiment, includes an amino acid sequence comprising residues 18 through 500 of FIG. 92 (SEQ ID NO:148).

In another aspect, the invention concerns an isolated PRO1347 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 500, inclusive of FIG. 92 (SEQ ID NO:148).

In a further aspect, the invention concerns an isolated PRO1347 polypeptide, comprising an amino acid sequence scoring at least about 80% positives, preferably at least about 85% positives, more preferably at least about 90% positives, most preferably at least about 95% positives when compared with the amino acid sequence of residues 18 through 500 of FIG. 92 (SEQ ID NO:148).

In yet another aspect, the invention concerns an isolated PRO1347 polypeptide, comprising the sequence of amino acid residues 18 to about 500, inclusive of FIG. 92 (SEQ ID NO:148), or a fragment thereof sufficient to provide a binding site for an anti-PRO1347 antibody. Preferably, the PRO1347 fragment retains a qualitative biological activity of a native PRO1347 polypeptide.

In a still further aspect, the invention provides a polypeptide produced by (i) hybridizing a test DNA molecule under stringent conditions with (a) a DNA molecule encoding a PRO1347 polypeptide having the sequence of amino acid residues from about 18 to about 500, inclusive of FIG. 92 (SEQ ID NO:148), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1347 polypeptide. In a particular embodiment, the agonist or antagonist is an anti-PRO1347 antibody.

In a further embodiment, the invention concerns a method of identifying agonists or antagonists of a native PRO1347 polypeptide, by contacting the native PRO1347 polypeptide with a candidate molecule and monitoring a biological activity mediated by said polypeptide.

In a still further embodiment, the invention concerns a composition comprising a PRO1347 polypeptide, or an agonist or antagonist as hereinabove defined, in combination with a pharmaceutically acceptable carrier.

47. PRO1305

A cDNA clone (DNA64952-1568) has been identified that encodes a novel secreted polypeptide, designated in the present application as "PRO1305".

In one embodiment, the invention provides an isolated nucleic acid molecule comprising DNA encoding a PRO1305 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1305 polypeptide having the sequence of amino acid residues from about 1 or about 26 to about 258, inclusive of FIG. 94 (SEQ ID NO:153), or (b) the complement of the DNA molecule of (a).

In another aspect, the invention concerns an isolated nucleic acid molecule encoding a PRO1305 polypeptide comprising DNA hybridizing to the complement of the nucleic acid between about nucleotides 126 or about 201 and about 899, inclusive, of FIG. 93 (SEQ ID NO:152). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203222 (DNA64952-1568) or (b) the complement of the nucleic acid molecule of (a). In a preferred embodiment, the nucleic acid comprises a DNA encoding the same mature polypeptide encoded by the human protein cDNA in ATCC Deposit No. 203222 (DNA64952-1568).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 258, inclusive of FIG. 94 (SEQ ID NO:153), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1305 polypeptide having the sequence of amino acid residues from 1 or about 26 to about 258, inclusive of FIG. 94 (SEQ ID NO:153), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1305 polypeptide, with or without the N-terminal signal sequence and/or the initiating methionine, or is complementary to such encoding nucleic acid molecule. The signal peptide has been tentatively identified as extending from about amino acid position 1 to about amino acid position 25 in the sequence of FIG. 94 (SEQ ID NO:153).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 258, inclusive of FIG. 94 (SEQ ID NO:153), or (b) the complement of the DNA of (a).

Another embodiment is directed to fragments of a PRO1305 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 93 (SEQ ID NO:152).

In another embodiment, the invention provides isolated PRO1305 polypeptide encoded by any of the isolated nucleic acid sequences hereinabove identified.

In a specific aspect, the invention provides isolated native sequence PRO1305 polypeptide, which in certain embodiments, includes an amino acid sequence comprising residues 1 or about 26 to about 258 of FIG. 94 (SEQ ID NO:153).

In another aspect, the invention concerns an isolated PRO1305 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 258, inclusive of FIG. 94 (SEQ ID NO:153).

In a further aspect, the invention concerns an isolated PRO1305 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 258, inclusive of FIG. 94 (SEQ ID NO:153).

In yet another aspect, the invention concerns an isolated PRO1305 polypeptide, comprising the sequence of amino acid residues 1 or about 26 to about 258, inclusive of FIG. 94 (SEQ ID NO:153), or a fragment thereof sufficient to provide a binding site for an anti-PRO1305 antibody. Preferably, the PRO1305 fragment retains a qualitative biological activity of a native PRO1305 polypeptide.

In a still further aspect, the invention provides a polypeptide produced by (i) hybridizing a test DNA molecule under stringent conditions with (a) a DNA molecule encoding a PRO1305 polypeptide having the sequence of amino acid residues from about 1 or about 26 to about 258, inclusive of FIG. 94 (SEQ ID NO:153), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

48. PRO1273

A cDNA clone (DNA65402-1540) has been identified that encodes a novel polypeptide having sequence identity with lipocalins and designated in the present application as "PRO1273."

In one embodiment, the invention provides an isolated nucleic acid molecule comprising DNA encoding a PRO1273 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1273 polypeptide having the sequence of amino acid residues from 1 or about 21 to about 163, inclusive of FIG. 96 (SEQ ID NO:158), or (b) the complement of the DNA molecule of (a).

In another aspect, the invention concerns an isolated nucleic acid molecule encoding a PRO1273 polypeptide comprising DNA hybridizing to the complement of the nucleic acid between about residues 86 and about 514, inclusive, of FIG. 95 (SEQ ID NO:157). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203252 (DNA65402-1540), or (b) the complement of the DNA molecule of (a). In a preferred embodiment, the nucleic acid comprises a DNA encoding the same mature polypeptide encoded by the human protein cDNA in ATCC Deposit No. 203252 (DNA65402-1540).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 163, inclusive of FIG. 96 (SEQ ID NO:158), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1273 polypeptide having the sequence of amino acid residues from about 21 to about 163, inclusive of FIG. 96 (SEQ ID NO:158), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 163, inclusive of FIG. 96 (SEQ ID NO:158), or (b) the complement of the DNA of (a).

Another embodiment is directed to fragments of a PRO1273 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1273 polypeptide encoded by any of the isolated nucleic acid sequences hereinabove defined.

In a specific aspect, the invention provides isolated native sequence PRO1273 polypeptide, which in one embodiment, includes an amino acid sequence comprising residues 21 through 163 of FIG. 96 (SEQ ID NO:158).

In another aspect, the invention concerns an isolated PRO1273 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 163, inclusive of FIG. 96 (SEQ ID NO:158).

In a further aspect, the invention concerns an isolated PRO1273 polypeptide, comprising an amino acid sequence scoring at least about 80% positives, preferably at least about 85% positives, more preferably at least about 90% positives, most preferably at least about 95% positives when compared with the amino acid sequence of residues 21 through 163 of FIG. 96 (SEQ ID NO:158).

In yet another aspect, the invention concerns an isolated PRO1273 polypeptide, comprising the sequence of amino acid residues 21 to about 163, inclusive of FIG. 96 (SEQ ID NO:158), or a fragment thereof sufficient to provide a binding site for an anti-PRO1273 antibody. Preferably, the PRO1273 fragment retains a qualitative biological activity of a native PRO1273 polypeptide.

In a still further aspect, the invention provides a polypeptide produced by (i) hybridizing a test DNA molecule under stringent conditions with (a) a DNA molecule encoding a PRO1273 polypeptide having the sequence of amino acid residues from about 21 to about 163, inclusive of FIG. 96 (SEQ ID NO:158), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1273 polypeptide. In a particular embodiment, the agonist or antagonist is an anti-PRO1273 antibody.

In a further embodiment, the invention concerns a method of identifying agonists or antagonists of a native PRO1273 polypeptide, by contacting the native PRO1273 polypeptide with a candidate molecule and monitoring a biological activity mediated by said polypeptide.

In a still further embodiment, the invention concerns a composition comprising a PRO1273 polypeptide, or an agonist or antagonist as hereinabove defined, in combination with a pharmaceutically acceptable carrier.

49. PRO1302

A cDNA clone (DNA65403-1565) has been identified that encodes a novel polypeptide having sequence identity with CD33 and designated in the present application as "PRO1302."

In one embodiment, the invention provides an isolated nucleic acid molecule comprising DNA encoding a PRO1302 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1302 polypeptide having the sequence of amino acid residues from 1 or about 16 to about 463, inclusive of FIG. 98 (SEQ ID NO:160), or (b) the complement of the DNA molecule of (a).

In another aspect, the invention concerns an isolated nucleic acid molecule encoding a PRO1302 polypeptide comprising DNA hybridizing to the complement of the nucleic acid between about residues 88 and about 1431, inclusive, of FIG. 97 (SEQ ID NO:159). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203230 (DNA65403-1565), or (b) the complement of the DNA molecule of (a). In a preferred embodiment, the nucleic acid comprises a DNA encoding the same mature polypeptide encoded by the human protein cDNA in ATCC Deposit No. 203230 (DNA65403-1565).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 16 to about 463, inclusive of FIG. 98 (SEQ ID NO:160), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1302 polypeptide having the sequence of amino acid residues from about 16 to about 463, inclusive of FIG. 98 (SEQ ID NO:160), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1302 polypeptide, with or without the N-terminal signal sequence and/or the initiating methionine, and its soluble, i.e. transmembrane domain deleted (or truncated form) or inactivated variants, or is complementary to such encoding nucleic acid molecule. The signal peptide has been tentatively identified as extending from amino acid position 1 through about amino acid position 15 in the sequence of FIG. 98 (SEQ ID NO:160). The transmembrane domain has been tentatively identified as extending from about amino acid position 351 through about amino acid position 370 in the PRO1302 amino acid sequence (FIG. 98, SEQ ID NO:160).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 16 to about 463, inclusive of FIG. 98 (SEQ ID NO:160), or (b) the complement of the DNA of (a).

Another embodiment is directed to fragments of a PRO1302 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1302 polypeptide encoded by any of the isolated nucleic acid sequences hereinabove defined.

In a specific aspect, the invention provides isolated native sequence PRO1302 polypeptide, which in one embodiment, includes an amino acid sequence comprising residues 16 through 463 of FIG. 98 (SEQ ID NO:160).

In another aspect, the invention concerns an isolated PRO1302 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 16 to about 463, inclusive of FIG. 98 (SEQ ID NO:160).

In a further aspect, the invention concerns an isolated PRO1302 polypeptide, comprising an amino acid sequence scoring at least about 80% positives, preferably at least about 85% positives, more preferably at least about 90% positives, most preferably at least about 95% positives when compared with the amino acid sequence of residues 16 through 463 of FIG. 98 (SEQ ID NO:160).

In yet another aspect, the invention concerns an isolated PRO1302 polypeptide, comprising the sequence of amino acid residues 16 to about 463, inclusive of FIG. 98 (SEQ ID NO:160), or a fragment thereof sufficient to provide a binding site for an anti-PRO1302 antibody. Preferably, the PRO1302 fragment retains a qualitative biological activity of a native PRO1302 polypeptide.

In a still further aspect, the invention provides a polypeptide produced by (i) hybridizing a test DNA molecule under stringent conditions with (a) a DNA molecule encoding a PRO1302 polypeptide having the sequence of amino acid residues from about 16 to about 463, inclusive of FIG. 98 (SEQ ID NO:160), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1302 polypeptide. In a particular embodiment, the agonist or antagonist is an anti-PRO1302 antibody.

In a further embodiment, the invention concerns a method of identifying agonists or antagonists of a native PRO1302 polypeptide, by contacting the native PRO1302 polypeptide with a candidate molecule and monitoring a biological activity mediated by said polypeptide.

In a still further embodiment, the invention concerns a composition comprising a PRO1302 polypeptide, or an agonist or antagonist as hereinabove defined, in combination with a pharmaceutically acceptable carrier.

50. PRO1283

A cDNA clone (DNA65404-1551) has been identified, having homology to nucleic acid encoding odorant binding protein, that encodes a novel polypeptide, designated in the present application as "PRO1283".

In one embodiment, the invention provides an isolated nucleic acid molecule comprising DNA encoding a PRO1283 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1283 polypeptide having the sequence of amino acid residues from about 1 or about 18 to about 170, inclusive of FIG. 100 (SEQ ID NO:162), or (b) the complement of the DNA molecule of (a).

In another aspect, the invention concerns an isolated nucleic acid molecule encoding a PRO1283 polypeptide comprising DNA hybridizing to the complement of the nucleic acid between about nucleotides 45 or about 96 and about 554, inclusive, of FIG. 99 (SEQ ID NO:161). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203244 (DNA65404-1551) or (b) the complement of the nucleic acid molecule of (a). In a preferred embodiment, the nucleic acid comprises a DNA encoding the same mature polypeptide encoded by the human protein cDNA in ATCC Deposit No. 203244 (DNA65404-1551).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 18 to about 170, inclusive of FIG. 100 (SEQ ID NO:162), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1283 polypeptide having the sequence of amino acid residues from 1 or about 18 to about 170, inclusive of FIG. 100 (SEQ ID NO:162), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1283 polypeptide, with or without the N-terminal signal sequence and/or the initiating methionine, or is complementary to such encoding nucleic acid molecule. The signal peptide has been tentatively identified as extending from about amino acid position 1 to about amino acid position 17 in the sequence of FIG. 100 (SEQ ID NO:162).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 18 to about 170, inclusive of FIG. 100 (SEQ ID NO:162), or (b) the complement of the DNA of (a).

Another embodiment is directed to fragments of a PRO1283 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 99 (SEQ ID NO:161).

In another embodiment, the invention provides isolated PRO1283 polypeptide encoded by any of the isolated nucleic acid sequences hereinabove identified.

In a specific aspect, the invention provides isolated native sequence PRO1283 polypeptide, which in certain embodiments, includes an amino acid sequence comprising residues 1 or about 18 to about 170 of FIG. 100 (SEQ ID NO:162).

In another aspect, the invention concerns an isolated PRO1283 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 18 to about 170, inclusive of FIG. 100 (SEQ ID NO:162).

In a further aspect, the invention concerns an isolated PRO1283 polypeptide, comprising an amino acid sequence scoring at least about 80% positives, preferably at least about 85% positives, more preferably at least about 90% positives, most preferably at least about 95% positives when compared with the amino acid sequence of residues 1 or about 18 to about 170, inclusive of FIG. 100 (SEQ ID NO:162).

In yet another aspect, the invention concerns an isolated PRO1283 polypeptide, comprising the sequence of amino acid residues 1 or about 18 to about 170, inclusive of FIG. 100 (SEQ ID NO:162), or a fragment thereof sufficient to provide a binding site for an anti-PRO1283 antibody. Preferably, the PRO1283 fragment retains a qualitative biological activity of a native PRO1283 polypeptide.

In a still further aspect, the invention provides a polypeptide produced by (i) hybridizing a test DNA molecule under stringent conditions with (a) a DNA molecule encoding a PRO1283 polypeptide having the sequence of amino acid residues from about 1 or about 18 to about 170, inclusive of FIG. 100 (SEQ ID NO:162), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1283 polypeptide. In a particular embodiment, the agonist or antagonist is an anti-PRO1283 antibody.

In a further embodiment, the invention concerns a method of identifying agonists or antagonists of a native PRO1283 polypeptide by contacting the native PRO1283 polypeptide with a candidate molecule and monitoring a biological activity mediated by said polypeptide.

In a still further embodiment, the invention concerns a composition comprising a PRO1283 polypeptide, or an agonist or antagonist as hereinabove defined, in combination with a pharmaceutically acceptable carrier.

51. PRO1279

A cDNA clone (DNA65405-1547) has been identified, having homology to nucleic acid encoding neuropsin that encodes a novel polypeptide, designated in the present application as "PRO1279".

In one embodiment, the invention provides an isolated nucleic acid molecule comprising DNA encoding a PRO1279 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1279 polypeptide having the sequence of amino acid residues from about 1 or about 19 to about 250, inclusive of FIG. 102 (SEQ ID NO:170), or (b) the complement of the DNA molecule of (a).

In another aspect, the invention concerns an isolated nucleic acid molecule encoding a PRO1279 polypeptide comprising DNA hybridizing to the complement of the nucleic acid between about nucleotides 106 or about 160 and about 855, inclusive, of FIG. 101 (SEQ ID NO:169). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203476 (DNA65405-1547) or (b) the complement of the nucleic acid molecule of (a). In a preferred embodiment, the nucleic acid comprises a DNA encoding the same mature polypeptide encoded by the human protein cDNA in ATCC Deposit No. 203476 (DNA65405-1547).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 19 to about 250, inclusive of FIG. 102 (SEQ ID NO:170), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1279 polypeptide having the sequence of amino acid residues from 1 or about 19 to about 250, inclusive of FIG. 102 (SEQ ID NO:170), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1279 polypeptide, with or without the N-terminal signal sequence and/or the initiating methionine, or is complementary to such encoding nucleic acid molecule. The signal peptide has been tentatively identified as extending from about amino acid position 1 to about amino acid position 18 in the sequence of FIG. 102 (SEQ ID NO:170).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 19 to about 250, inclusive of FIG. 102 (SEQ ID NO:170), or (b) the complement of the DNA of (a).

Another embodiment is directed to fragments of a PRO1279 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 101 (SEQ ID NO:169).

In another embodiment, the invention provides isolated PRO1279 polypeptide encoded by any of the isolated nucleic acid sequences hereinabove identified.

In a specific aspect, the invention provides isolated native sequence PRO1279 polypeptide, which in certain embodiments, includes an amino acid sequence comprising residues 1 or about 19 to about 250 of FIG. 102 (SEQ ID NO:170).

In another aspect, the invention concerns an isolated PRO1279 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 19 to about 250, inclusive of FIG. 102 (SEQ ID NO:170).

In a further aspect, the invention concerns an isolated PRO1279 polypeptide, comprising an amino acid sequence scoring at least about 80% positives, preferably at least about 85% positives, more preferably at least about 90% positives, most preferably at least about 95% positives when compared with the amino acid sequence of residues 1 or about 19 to about 250, inclusive of FIG. 102 (SEQ ID NO:170).

In yet another aspect, the invention concerns an isolated PRO1279 polypeptide, comprising the sequence of amino acid residues 1 or about 19 to about 250, inclusive of FIG. 102 (SEQ ID NO:170), or a fragment thereof sufficient to provide a binding site for an anti-PRO1279 antibody. Preferably, the PRO1279 fragment retains a qualitative biological activity of a native PRO1279 polypeptide.

In a still further aspect, the invention provides a polypeptide produced by (i) hybridizing a test DNA molecule under stringent conditions with (a) a DNA molecule encoding a PRO1279 polypeptide having the sequence of amino acid residues from about 1 or about 19 to about 250, inclusive of FIG. 102 (SEQ ID NO:170), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1279 polypeptide. In a particular embodiment, the agonist or antagonist is an anti-PRO1279 antibody.

In a further embodiment, the invention concerns a method of identifying agonists or antagonists of a native PRO1279 polypeptide by contacting the native PRO1279 polypeptide with a candidate molecule and monitoring a biological activity mediated by said polypeptide.

In a still further embodiment, the invention concerns a composition comprising a PRO1279 polypeptide, or an agonist or antagonist as hereinabove defined, in combination with a pharmaceutically acceptable carrier.

52. PRO1304

A cDNA clone (DNA65406-1567) has been identified, having homology to nucleic acid encoding FK506 binding protein that encodes a novel polypeptide, designated in the present application as "PRO1304".

In one embodiment, the invention provides an isolated nucleic acid molecule comprising DNA encoding a PRO1304 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1304 polypeptide having the sequence of amino acid residues from about 1 to about 222, inclusive of FIG. 104 (SEQ ID NO:180), or (b) the complement of the DNA molecule of (a).

In another aspect, the invention concerns an isolated nucleic acid molecule encoding a PRO1304 polypeptide comprising DNA hybridizing to the complement of the nucleic acid between about nucleotides 23 and about 688, inclusive, of FIG. 103 (SEQ ID NO:179). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203219 (DNA65406-1567) or (b) the complement of the nucleic acid molecule of (a). In a preferred embodiment, the nucleic acid comprises a DNA encoding the same mature polypeptide encoded by the human protein cDNA in ATCC Deposit No. 203219 (DNA65406-1567).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 222, inclusive of FIG. 104 (SEQ ID NO:180), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1304 polypeptide having the sequence of amino acid residues from 1 to about 222, inclusive of FIG. 104 (SEQ ID NO:180), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1304 polypeptide, with or without the initiating methionine, or is complementary to such encoding nucleic acid molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 222, inclusive of FIG. 104 (SEQ ID NO:180), or (b) the complement of the DNA of (a).

Another embodiment is directed to fragments of a PRO1304 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 103 (SEQ ID NO:179).

In another embodiment, the invention provides isolated PRO1304 polypeptide encoded by any of the isolated nucleic acid sequences hereinabove identified.

In a specific aspect, the invention provides isolated native sequence PRO1304 polypeptide, which in certain embodiments, includes an amino acid sequence comprising residues 1 to about 222 of FIG. 104 (SEQ ID NO:180).

In another aspect, the invention concerns an isolated PRO1304 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 222, inclusive of FIG. 104 (SEQ ID NO:180).

In a further aspect, the invention concerns an isolated PRO1304 polypeptide, comprising an amino acid sequence scoring at least about 80% positives, preferably at least about 85% positives, more preferably at least about 90% positives, most preferably at least about 95% positives when compared with the amino acid sequence of residues 1 to about 222, inclusive of FIG. 104 (SEQ ID NO:180).

In yet another aspect, the invention concerns an isolated PRO1304 polypeptide, comprising the sequence of amino acid residues 1 to about 222, inclusive of FIG. 104 (SEQ ID NO:180), or a fragment thereof sufficient to provide a binding site for an anti-PRO1304 antibody. Preferably, the PRO1304 fragment retains a qualitative biological activity of a native PRO1304 polypeptide.

In a still further aspect, the invention provides a polypeptide produced by (i) hybridizing a test DNA molecule under stringent conditions with (a) a DNA molecule encoding a PRO1304 polypeptide having the sequence of amino acid residues from about 1 to about 222, inclusive of FIG. 104 (SEQ ID NO:180), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1304 polypeptide. In a particular embodiment, the agonist or antagonist is an anti-PRO1304 antibody.

In a further embodiment, the invention concerns a method of identifying agonists or antagonists of a native PRO1304 polypeptide by contacting the native PRO1304 polypeptide with a candidate molecule and monitoring a biological activity mediated by said polypeptide.

In a still further embodiment, the invention concerns a composition comprising a PRO1304 polypeptide, or an agonist or antagonist as hereinabove defined, in combination with a pharmaceutically acceptable carrier.

53. PRO1317

A cDNA clone (DNA65408-1578) has been identified that encodes a novel secreted polypeptide that shares homology with human CD97. The novel polypeptide is designated in the present application as "PRO1317".

In one embodiment, the invention provides an isolated nucleic acid molecule comprising DNA encoding a PRO1317 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1317 polypeptide having the sequence of amino acid residues from 1 or about 19 to about 74, inclusive of FIG. 106 (SEQ ID NO:189), or (b) the complement of the DNA molecule of (a).

In another aspect, the invention concerns an isolated nucleic acid molecule encoding a PRO1317 polypeptide comprising DNA hybridizing to the complement of the nucleic acid between about residues 60 and about 227, inclusive, of FIG. 105 (SEQ ID NO:188). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203217 (DNA65408-1578), or (b) the complement of the DNA molecule of (a). In a preferred embodiment, the nucleic acid comprises a DNA encoding the same mature polypeptide encoded by the human protein cDNA in ATCC Deposit No. 203217 (DNA65408-1578).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 74, inclusive of FIG. 106 (SEQ ID NO:189), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1317 polypeptide having the sequence of amino acid residues from about 19 to about 74, inclusive of FIG. 106 (SEQ ID NO:189), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1317 polypeptide, with or without the N-terminal signal sequence and/or the initiating methionine, or is complementary to such encoding nucleic acid molecule. The signal peptide has been tentatively identified as extending from amino acid position 1 through about amino acid position 18 in the sequence of FIG. 106 (SEQ ID NO:189).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 74, inclusive of FIG. 106 (SEQ ID NO:189), or (b) the complement of the DNA of (a).

Another embodiment is directed to fragments of a PRO1317 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1317 polypeptide encoded by any of the isolated nucleic acid sequences hereinabove defined.

In a specific aspect, the invention provides isolated native sequence PRO1317 polypeptide, which in one embodiment, includes an amino acid sequence comprising residues 19 to 74 of FIG. 106 (SEQ ID NO:189).

In another aspect, the invention concerns an isolated PRO1317 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 74, inclusive of FIG. 106 (SEQ ID NO:189).

In a further aspect, the invention concerns an isolated PRO1317 polypeptide, comprising an amino acid sequence scoring at least about 80% positives, preferably at least about 85% positives, more preferably at least about 90% positives, most preferably at least about 95% positives when compared with the amino acid sequence of residues 19 to 74 of FIG. 106 (SEQ ID NO:189).

In yet another aspect, the invention concerns an isolated PRO1317 polypeptide, comprising the sequence of amino acid residues 19 to about 74, inclusive of FIG. 106 (SEQ ID NO:189), or a fragment thereof sufficient to provide a binding site for an anti-PRO1317 antibody. Preferably, the PRO1317 fragment retains a qualitative biological activity of a native PRO1317 polypeptide.

In a still further aspect, the invention provides a polypeptide produced by (i) hybridizing a test DNA molecule under stringent conditions with (a) a DNA molecule encoding a PRO1317 polypeptide having the sequence of amino acid residues from about 19 to about 74, inclusive of FIG. 106 (SEQ ID NO:189), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

54. PRO1303

A cDNA clone (DNA65409-1566) has been identified that encodes a novel polypeptide having sequence identity with proteases including neuropsin and designated in the present application as "PRO1303."

In one embodiment, the invention provides an isolated nucleic acid molecule comprising DNA encoding a PRO1303 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1303 polypeptide having the sequence of amino acid residues from 1 or about 18 to about 248, inclusive of FIG. 108 (SEQ ID NO:194), or (b) the complement of the DNA molecule of (a).

In another aspect, the invention concerns an isolated nucleic acid molecule encoding a PRO1303 polypeptide comprising DNA hybridizing to the complement of the nucleic acid between about residues 172 and about 864, inclusive, of FIG. 107 (SEQ ID NO:193). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203232 (DNA65409-1566), or (b) the complement of the DNA molecule of (a). In a preferred embodiment, the nucleic acid comprises a DNA encoding the same mature polypeptide encoded by the human protein cDNA in ATCC Deposit No. 203232 (DNA65409-1566).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 248, inclusive of FIG. 108 (SEQ ID NO:194), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1303 polypeptide having the sequence of amino acid residues from about 18 to about 248, inclusive of FIG. 108 (SEQ ID NO:194), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 248, inclusive of FIG. 108 (SEQ ID NO:194), or (b) the complement of the DNA of (a).

Another embodiment is directed to fragments of a PRO1303 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1303 polypeptide encoded by any of the isolated nucleic acid sequences hereinabove defined.

In a specific aspect, the invention provides isolated native sequence PRO1303 polypeptide, which in one embodiment, includes an amino acid sequence comprising residues 18 through 248 of FIG. 108 (SEQ ID NO:194).

In another aspect, the invention concerns an isolated PRO1303 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 248, inclusive of FIG. 108 (SEQ ID NO:194).

In a further aspect, the invention concerns an isolated PRO1303 polypeptide, comprising an amino acid sequence scoring at least about 80% positives, preferably at least about 85% positives, more preferably at least about 90% positives, most preferably at least about 95% positives when compared with the amino acid sequence of residues 18 through 248 of FIG. 108 (SEQ ID NO:194).

In yet another aspect, the invention concerns an isolated PRO1303 polypeptide, comprising the sequence of amino acid residues 18 to about 248, inclusive of FIG. 108 (SEQ ID NO:194), or a fragment thereof sufficient to provide a binding site for an anti-PRO1303 antibody. Preferably, the PRO1303 fragment retains a qualitative biological activity of a native PRO1303 polypeptide.

In a still further aspect, the invention provides a polypeptide produced by (i) hybridizing a test DNA molecule under stringent conditions with (a) a DNA molecule encoding a PRO1303 polypeptide having the sequence of amino acid residues from about 18 to about 248, inclusive of FIG. 108 (SEQ ID NO:194), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1303 polypeptide. In a particular embodiment, the agonist or antagonist is an anti-PRO1303 antibody.

In a further embodiment, the invention concerns a method of identifying agonists or antagonists of a native PRO1303 polypeptide, by contacting the native PRO1303 polypeptide with a candidate molecule and monitoring a biological activity mediated by said polypeptide.

In a still further embodiment, the invention concerns a composition comprising a PRO1303 polypeptide, or an agonist or antagonist as hereinabove defined, in combination with a pharmaceutically acceptable carrier.

55. PRO1306

A cDNA clone (DNA65410-1569) has been identified that encodes a novel polypeptide having homology to AIF1/daintain and designated in the present application as "PRO1306".

In one embodiment, the invention provides an isolated nucleic acid molecule comprising DNA encoding a PRO1306 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1306 polypeptide having the sequence of amino acid residues from about 1 to about 150, inclusive of FIG. 110 (SEQ ID NO:196), or (b) the complement of the DNA molecule of (a).

In another aspect, the invention concerns an isolated nucleic acid molecule encoding a PRO1306 polypeptide comprising DNA hybridizing to the complement of the nucleic acid between about residues 106 and about 555, inclusive, of FIG. 109 (SEQ ID NO:195). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203231 (DNA65410-1569), or (b) the complement of the DNA molecule of (a). In a preferred embodiment, the nucleic acid comprises a DNA encoding the same mature polypeptide encoded by the human protein cDNA in ATCC Deposit No. 203231 (DNA65410-1569).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 150, inclusive of FIG. 110 (SEQ ID NO:196), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1306 polypeptide having the sequence of amino acid residues from about 1 to about 150, inclusive of FIG. 110 (SEQ ID NO:196), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 150, inclusive of FIG. 110 (SEQ ID NO:196), or (b) the complement of the DNA of (a).

Another embodiment is directed to fragments of a PRO1306 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1306 polypeptide encoded by any of the isolated nucleic acid sequences hereinabove defined.

In a specific aspect, the invention provides isolated native sequence PRO1306 polypeptide, which in one embodiment, includes an amino acid sequence comprising residues 1 to 150 of FIG. 110 (SEQ ID NO:196).

In another aspect, the invention concerns an isolated PRO1306 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 150, inclusive of FIG. 110 (SEQ ID NO:196).

In a further aspect, the invention concerns an isolated PRO1306 polypeptide, comprising an amino acid sequence scoring at least about 80% positives, preferably at least about 85% positives, more preferably at least about 90% positives, most preferably at least about 95% positives when compared with the amino acid sequence of residues 1 to 150 of FIG. 110 (SEQ ID NO:196).

In yet another aspect, the invention concerns an isolated PRO1306 polypeptide, comprising the sequence of amino acid residues 1 to about 150, inclusive of FIG. 110 (SEQ ID NO:196), or a fragment thereof sufficient to provide a binding site for an anti-PRO1306 antibody. Preferably, the PRO1306 fragment retains a qualitative biological activity of a native PRO1306 polypeptide.

In a still further aspect, the invention provides a polypeptide produced by (i) hybridizing a test DNA molecule under stringent conditions with (a) a DNA molecule encoding a PRO1306 polypeptide having the sequence of amino acid residues from about 1 to about 150, inclusive of FIG. 110 (SEQ ID NO:196), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1306 polypeptide. In a particular embodiment, the agonist or antagonist is an anti-PRO1306 antibody.

In a further embodiment, the invention concerns a method of identifying agonists or antagonists of a native PRO1306 polypeptide, by contacting the native PRO1306 polypeptide with a candidate molecule and monitoring a biological activity mediated by said polypeptide.

In a still further embodiment, the invention concerns a composition comprising a PRO1306 polypeptide, or an agonist or antagonist as hereinabove defined, in combination with a pharmaceutically acceptable carrier.

56. PRO1336

A cDNA clone (DNA65423-1595) has been identified that encodes a novel polypeptide having sequence identity with slit and designated in the present application as "PRO1336."

In one embodiment, the invention provides an isolated nucleic acid molecule comprising DNA encoding a PRO1336 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1336 polypeptide having the sequence of amino acid residues from 1 or about 28 to about 1523, inclusive of FIG.

112 (SEQ ID NO:198), or (b) the complement of the DNA molecule of (a).

In another aspect, the invention concerns an isolated nucleic acid molecule encoding a PRO1336 polypeptide comprising DNA hybridizing to the complement of the nucleic acid between about residues 164 and about 4651, inclusive, of FIGS. 111A–B (SEQ ID NO:197). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203227 (DNA65423-1595), or (b) the complement of the DNA molecule of (a). In a preferred embodiment, the nucleic acid comprises a DNA encoding the same mature polypeptide encoded by the human protein cDNA in ATCC Deposit No. 203227 (DNA65423-1595).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 28 to about 1523, inclusive of FIG. 112 (SEQ ID NO:198), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1336 polypeptide having the sequence of amino acid residues from about 28 to about 1523, inclusive of FIG. 112 (SEQ ID NO:198), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 28 to about 1523, inclusive of FIG. 112 (SEQ ID NO:198), or (b) the complement of the DNA of (a).

Another embodiment is directed to fragments of a PRO1336 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1336 polypeptide encoded by any of the isolated nucleic acid sequences hereinabove defined.

In a specific aspect, the invention provides isolated native sequence PRO1336 polypeptide, which in one embodiment, includes an amino acid sequence comprising residues 28 through 1523 of FIG. 112 (SEQ ID NO:198).

In another aspect, the invention concerns an isolated PRO1336 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 28 to about 1523, inclusive of FIG. 112 (SEQ ID NO:198).

In a further aspect, the invention concerns an isolated PRO1336 polypeptide, comprising an amino acid sequence scoring at least about 80% positives, preferably at least about 85% positives, more preferably at least about 90% positives, most preferably at least about 95% positives when compared with the amino acid sequence of residues 28 through 1523 of FIG. 112 (SEQ ID NO:198).

In yet another aspect, the invention concerns an isolated PRO1336 polypeptide, comprising the sequence of amino acid residues 28 to about 1523, inclusive of FIG. 112 (SEQ ID NO:198), or a fragment thereof sufficient to provide a binding site for an anti-PRO1336 antibody. Preferably, the PRO1336 fragment retains a qualitative biological activity of a native PRO1336 polypeptide.

In a still further aspect, the invention provides a polypeptide produced by (i) hybridizing a test DNA molecule under stringent conditions with (a) a DNA molecule encoding a PRO1336 polypeptide having the sequence of amino acid residues from about 28 to about 1523, inclusive of FIG. 112 (SEQ ID NO:198), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1336 polypeptide. In a particular embodiment, the agonist or antagonist is an anti-PRO1336 antibody.

In a further embodiment, the invention concerns a method of identifying agonists or antagonists of a native PRO1336 polypeptide, by contacting the native PRO1336 polypeptide with a candidate molecule and monitoring a biological activity mediated by said polypeptide.

In a still further embodiment, the invention concerns a composition comprising a PRO1336 polypeptide, or an agonist or antagonist as hereinabove defined, in combination with a pharmaceutically acceptable carrier.

57. PRO1278

A cDNA clone (DNA66304-1546) has been identified that encodes a novel polypeptide having homology to lysozyme C and designated in the present application as "PRO1278."

In one embodiment, the invention provides an isolated nucleic acid molecule comprising DNA encoding a PRO1278 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1278 polypeptide having the sequence of amino acid residues from 1 or about 20 to about 148, inclusive of FIG. 114 (SEQ ID NO:203), or (b) the complement of the DNA molecule of (a).

In another aspect, the invention concerns an isolated nucleic acid molecule encoding a PRO1278 polypeptide comprising DNA hybridizing to the complement of the nucleic acid between about residues 198 and about 584, inclusive, of FIG. 113 (SEQ ID NO:202). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203321 (DNA66304-1546), or (b) the complement of the DNA molecule of (a). In a preferred embodiment, the nucleic acid comprises a DNA encoding the same mature polypeptide encoded by the human protein cDNA in ATCC Deposit No. 203321 (DNA66304-1546).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 148, inclusive of FIG. 114 (SEQ ID NO:203), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1278 polypeptide having the sequence of amino acid residues from about 20 to about 148, inclusive of FIG. 114 (SEQ ID NO:203), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1278 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 19 in the sequence of FIG. 114 (SEQ ID NO:203).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 148, inclusive of FIG. 114 (SEQ ID NO:203), or (b) the complement of the DNA of (a).

Another embodiment is directed to fragments of a PRO1278 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1278 polypeptide encoded by any of the isolated nucleic acid sequences hereinabove defined.

In a specific aspect, the invention provides isolated native sequence PRO1278 polypeptide, which in one embodiment, includes an amino acid sequence comprising residues 20 to 148 of FIG. 114 (SEQ ID NO:203).

In another aspect, the invention concerns an isolated PRO1278 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 148, inclusive of FIG. 114 (SEQ ID NO:203).

In a further aspect, the invention concerns an isolated PRO1278 polypeptide, comprising an amino acid sequence scoring at least about 80% positives, preferably at least about 85% positives, more preferably at least about 90% positives, most preferably at least about 95% positives when compared with the amino acid sequence of residues 20 to 148 of FIG. 114 (SEQ ID NO:203).

In yet another aspect, the invention concerns an isolated PRO1278 polypeptide, comprising the sequence of amino acid residues 20 to about 148, inclusive of FIG. 114 (SEQ ID NO:203), or a fragment thereof sufficient to provide a binding site for an anti-PRO1278 antibody. Preferably, the PRO1278 fragment retains a qualitative biological activity of a native PRO1278 polypeptide.

In a still further aspect, the invention provides a polypeptide produced by (i) hybridizing a test DNA molecule under stringent conditions with (a) a DNA molecule encoding a PRO1278 polypeptide having the sequence of amino acid residues from about 20 to about 148, inclusive of FIG. 114 (SEQ ID NO:203), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1278 polypeptide. In a particular embodiment, the agonist or antagonist is an anti-PRO1278 antibody.

In a further embodiment, the invention concerns a method of identifying agonists or antagonists of a native PRO1278 polypeptide, by contacting the native PRO1278 polypeptide with a candidate molecule and monitoring a biological activity mediated by said polypeptide.

In a still further embodiment, the invention concerns a composition comprising a PRO1278 polypeptide, or an agonist or antagonist as hereinabove defined, in combination with a pharmaceutically acceptable carrier.

58. PRO1298

A cDNA clone (DNA66511-1563) has been identified that encodes a novel polypeptide having sequence identity with glycosyltransferases and designated in the present application as "PRO1298."

In one embodiment, the invention provides an isolated nucleic acid molecule comprising DNA encoding a PRO1298 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1298 polypeptide having the sequence of amino acid residues from 1 or about 16 to about 323, inclusive of FIG. 116 (SEQ ID NO:210), or (b) the complement of the DNA molecule of (a).

In another aspect, the invention concerns an isolated nucleic acid molecule encoding a PRO1298 polypeptide comprising DNA hybridizing to the complement of the nucleic acid between about residues 139 and about 1062, inclusive, of FIG. 115 (SEQ ID NO:209). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203228 (DNA66511-1563), or (b) the complement of the DNA molecule of (a). In a preferred embodiment, the nucleic acid comprises a DNA encoding the same mature polypeptide encoded by the human protein cDNA in ATCC Deposit No. 203228 (DNA66511-1563).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 16 to about 323, inclusive of FIG. 116 (SEQ ID NO:210), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1298 polypeptide having the sequence of amino acid residues from about 16 to about 323, inclusive of FIG. 116 (SEQ ID NO:210), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 16 to about 323, inclusive of FIG. 116 (SEQ ID NO:210), or (b) the complement of the DNA of (a).

Another embodiment is directed to fragments of a PRO1298 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1298 polypeptide encoded by any of the isolated nucleic acid sequences hereinabove defined.

In a specific aspect, the invention provides isolated native sequence PRO1298 polypeptide, which in one embodiment, includes an amino acid sequence comprising residues 16 through 323 of FIG. 116 (SEQ ID NO:210).

In another aspect, the invention concerns an isolated PRO1298 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 16 to about 323, inclusive of FIG. 116 (SEQ ID NO:210).

In a further aspect, the invention concerns an isolated PRO1298 polypeptide, comprising an amino acid sequence scoring at least about 80% positives, preferably at least about 85% positives, more preferably at least about 90% positives, most preferably at least about 95% positives when compared with the amino acid sequence of residues 16 through 323 of FIG. 116 (SEQ ID NO:210).

In yet another aspect, the invention concerns anisolated-PRO1298 polypeptide, comprising the sequence of amino acid residues 16 to about 323, inclusive of FIG. 116 (SEQ ID NO:210), or a fragment thereof sufficient to provide a binding site for an anti-PRO1298 antibody. Preferably, the PRO1298 fragment retains a qualitative biological activity of a native PRO1298 polypeptide.

In a still further aspect, the invention provides a polypeptide produced by (i) hybridizing a test DNA molecule under stringent conditions with (a) a DNA molecule encoding a PRO1298 polypeptide having the sequence of amino acid residues from about 16 to about 323, inclusive of FIG. 116 (SEQ ID NO:210), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1298 polypeptide. In a particular embodiment, the agonist or antagonist is an anti-PRO1298 antibody.

In a further embodiment, the invention concerns a method of identifying agonists or antagonists of a native PRO1298 polypeptide, by contacting the native PRO1298 polypeptide with a candidate molecule and monitoring a biological activity mediated by said polypeptide.

In a still further embodiment, the invention concerns a composition comprising a PRO1298 polypeptide, or an agonist or antagonist as hereinabove defined, in combination with a pharmaceutically acceptable carrier.

59. PRO1301

A cDNA clone (DNA66512-1564) has been identified that encodes a novel polypeptide having homology to cytochrome P450 and designated in the present application as "PRO1301."

In one embodiment, the invention provides an isolated nucleic acid molecule comprising DNA encoding a PRO1301 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1301 polypeptide having the sequence of amino acid residues from 1 or about 19 to about 462, inclusive of FIG. 118 (SEQ ID NO:212), or (b) the complement of the DNA molecule of (a).

In another aspect, the invention concerns an isolated nucleic acid molecule encoding a PRO1301 polypeptide comprising DNA hybridizing to the complement of the nucleic acid between about residues 97 and about 1428, inclusive, of FIG. 117 (SEQ ID NO:211). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203218 (DNA66512-1564), or (b) the complement of the DNA molecule of (a). In a preferred embodiment, the nucleic acid comprises a DNA encoding the same mature polypeptide encoded by the human protein cDNA in ATCC Deposit No. 203218 (DNA66512-1564).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 462, inclusive of FIG. 118 (SEQ ID NO:212), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1301 polypeptide having the sequence of amino acid residues from about 19 to about 462, inclusive of FIG. 118 (SEQ ID NO:212), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1301 polypeptide, with or without the N-terminal signal sequence and/or the initiating methionine and its soluble, i.e. transmembrane domain deleted or inactivated variants, or is complementary to such encoding nucleic acid molecule. The signal peptide has been tentatively identified as extending from amino acid position 1 through about amino acid position 18 in the sequence of FIG. 118 (SEQ ID NO:212). The transmembrane domain has been tentatively identified as extending from about amino acid position 271 through about amino acid position 290 in the PRO1301 amino acid sequence (FIG. 118, SEQ ID NO:212).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 462, inclusive of FIG. 118 (SEQ ID NO:212), or (b) the complement of the DNA of (a).

Another embodiment is directed to fragments of a PRO1301 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1301 polypeptide encoded by any of the isolated nucleic acid sequences hereinabove defined.

In a specific aspect, the invention provides isolated native sequence PRO1301 polypeptide, which in one embodiment, includes an amino acid sequence comprising residues 19 to 462 of FIG. 118 (SEQ ID NO:212).

In another aspect, the invention concerns an isolated PRO1301 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 462, inclusive of FIG. 118 (SEQ ID NO:212).

In a further aspect, the invention concerns an isolated PRO1301 polypeptide, comprising an amino acid sequence scoring at least about 80% positives, preferably at least about 85% positives, more preferably at least about 90% positives, most preferably at least about 95% positives when compared with the amino acid sequence of residues 19 to 462 of FIG. 118 (SEQ ID NO:212).

In yet another aspect, the invention concerns an isolated PRO11301 polypeptide, comprising the sequence of amino acid residues 19 to about 462, inclusive of FIG. 118 (SEQ ID NO:212), or a fragment thereof sufficient to provide a binding site for an anti-PRO1301 antibody. Preferably, the PRO1301 fragment retains a qualitative biological activity of a native PRO1301 polypeptide.

In a still further aspect, the invention provides a polypeptide produced by (i) hybridizing a test DNA molecule under stringent conditions with (a) a DNA molecule encoding a PRO1301 polypeptide having the sequence of amino acid residues from about 19 to about 462, inclusive of FIG. 118 (SEQ ID NO:212), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

60. PRO1268

A cDNA clone (DNA66519-1535) has been identified that encodes a novel transmembrane polypeptide designated in the present application as "PRO1268."

In one embodiment, the invention provides an isolated nucleic acid molecule comprising DNA encoding a PRO1268 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1268 polypeptide having the sequence of amino acid residues from about 1 to about 140, inclusive of FIG. 120 (SEQ ID NO:214), or (b) the complement of the DNA molecule of (a).

In another aspect, the invention concerns an isolated nucleic acid molecule encoding a PRO1268 polypeptide comprising DNA hybridizing to the complement of the nucleic acid between about residues 89 and about 508, inclusive, of FIG. 119 (SEQ ID NO:213). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203236 (DNA66519-1535), or (b) the complement of the DNA molecule of (a). In a preferred embodiment, the nucleic acid comprises a DNA encoding the same mature polypeptide encoded by the human protein cDNA in ATCC Deposit No. 203236 (DNA66519-1535).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 140, inclusive of FIG. 120 (SEQ ID NO:214), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1268 polypeptide having the sequence of amino acid residues from about 1 to about 140, inclusive of FIG. 120 (SEQ ID NO:214), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1268 polypeptide, with one or more of its soluble, i.e. transmembrane, domains deleted or inactivated, or is complementary to such encoding nucleic acid molecule. Transmembrane domains has been tentatively identified at about amino acids 12-28 (type II), 5166, and 107-124 in the PRO1268 amino acid sequence (FIG. 120, SEQ ID NO:214).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 140, inclusive of FIG. 120 (SEQ ID NO:214), or (b) the complement of the DNA of (a).

Another embodiment is directed to fragments of a PRO1268 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1268 polypeptide encoded by any of the isolated nucleic acid sequences hereinabove defined.

In a specific aspect, the invention provides isolated native sequence PRO1268 polypeptide, which in one embodiment, includes an amino acid sequence comprising residues 1 to 140 of FIG. 120 (SEQ ID NO:214).

In another aspect, the invention concerns an isolated PRO1268 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 140, inclusive of FIG. 120 (SEQ ID NO:214).

In a further aspect, the invention concerns an isolated PRO1268 polypeptide, comprising an amino acid sequence scoring at least about 80% positives, preferably at least about 85% positives, more preferably at least about 90% positives, most preferably at least about 95% positives when compared with the amino acid sequence of residues 1 to 140 of FIG. 120 (SEQ ID NO:214).

In yet another aspect, the invention concerns an isolated PRO1268 polypeptide, comprising the sequence of amino acid residues 1 to about 140, inclusive of FIG. 120 (SEQ ID NO:214), or a fragment thereof sufficient to provide a binding site for an anti-PRO1268 antibody. Preferably, the PRO1268 fragment retains a qualitative biological activity of a native PRO1268 polypeptide.

In a still further aspect, the invention provides a polypeptide produced by (i) hybridizing a test DNA molecule under stringent conditions with (a) a DNA molecule encoding a PRO1268 polypeptide having the sequence of amino acid residues from about 1 to about 140, inclusive of FIG. 120 (SEQ ID NO:214), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

61. PRO1269

A cDNA clone (DNA66520-1536) has been identified that encodes a novel polypeptide having homology to granulocyte peptide A and designated in the present application as "PRO1269."

In one embodiment, the invention provides an isolated nucleic acid molecule comprising DNA encoding a PRO1269 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1269 polypeptide having the sequence of amino acid residues from 1 or about 21 to about 196, inclusive of FIG. 122 (SEQ ID NO:216), or (b) the complement of the DNA molecule of (a).

In another aspect, the invention concerns an isolated nucleic acid molecule encoding a PRO1269 polypeptide comprising DNA hybridizing to the complement of the nucleic acid between about residues 86 and about 613, inclusive, of FIG. 121 (SEQ ID NO:215). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203226 (DNA66520-1536), or (b) the complement of the DNA molecule of (a). In a preferred embodiment, the nucleic acid comprises a DNA encoding the same mature polypeptide encoded by the human protein cDNA in ATCC Deposit No. 203226 (DNA66520-1536).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 196, inclusive of FIG. 122 (SEQ ID NO:216), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1269 polypeptide having the sequence of amino acid residues from about 21 to about 196, inclusive of FIG. 122 (SEQ ID NO:216), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1269 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 20 in the sequence of FIG. 122 (SEQ ID NO:216).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 196, inclusive of FIG. 122 (SEQ ID NO:21)6, or (b) the complement of the DNA of (a).

Another embodiment is directed to fragments of a PRO1269 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1269 polypeptide encoded by any of the isolated nucleic acid sequences hereinabove defined.

In a specific aspect, the invention provides isolated native sequence PRO1269 polypeptide, which in one embodiment, includes an amino acid sequence comprising residues 21 to 196 of FIG. 122 (SEQ ID NO:216).

In another aspect, the invention concerns an isolated PRO1269 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 196, inclusive of FIG. 122 (SEQ ID NO:216).

In a further aspect, the invention concerns an isolated PRO1269 polypeptide, comprising an amino acid sequence scoring at least about 80% positives, preferably at least about 85% positives, more preferably at least about 90% positives, most preferably at least about 95% positives when compared with the amino acid sequence of residues 21 to 196 of FIG. 122 (SEQ ID NO:216).

In yet another aspect, the invention concerns an isolated PRO1269 polypeptide, comprising the sequence of amino acid residues 21 to about 196, inclusive of FIG. 122 (SEQ ID NO:216), or a fragment thereof sufficient to provide a binding site for an anti-PRO1269 antibody. Preferably, the PRO1269 fragment retains a qualitative biological activity of a native PRO1269 polypeptide.

In a still further aspect, the invention provides a polypeptide produced by (i) hybridizing a test DNA molecule under stringent conditions with (a) a DNA molecule encoding a PRO1269 polypeptide having the sequence of amino acid residues from about 21 to about 196, inclusive of FIG. 122 (SEQ ID NO:216), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1269 polypeptide. In a particular embodiment, the agonist or antagonist is an anti-PRO1269 antibody.

In a further embodiment, the invention concerns a method of identifying agonists or antagonists of a native PRO1269 polypeptide, by contacting the native PRO1269 polypeptide with a candidate molecule and monitoring a biological activity mediated by said polypeptide.

In a still further embodiment, the invention concerns a composition comprising a PRO1269 polypeptide, or an agonist or antagonist as hereinabove defined, in combination with a pharmaceutically acceptable carrier.

62. PRO1327

A cDNA clone (DNA66521-1583) has been identified, having homology to nucleic acid encoding neurexoplilin, that encodes a novel polypeptide, designated in the present application as "PRO1327".

In one embodiment, the invention provides an isolated nucleic acid molecule comprising DNA encoding a PRO1327 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1327 polypeptide having the sequence of amino acid residues from about 1 or about 15 to about 252, inclusive of FIG. 124 (SEQ ID NO:218), or (b) the complement of the DNA molecule of (a).

In another aspect, the invention concerns an isolated nucleic acid molecule encoding a PRO1327 polypeptide comprising DNA hybridizing to the complement of the nucleic acid between about nucleotides 55 or about 97 and about 810, inclusive, of FIG. 123 (SEQ ID NO:217). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203225 (DNA66521-1583) or (b) the complement of the nucleic acid molecule of (a). In a preferred embodiment, the nucleic acid comprises a DNA encoding the same mature polypeptide encoded by the human protein cDNA in ATCC Deposit No. 203225 (DNA66521-1583).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 15 to about 252, inclusive of FIG. 124 (SEQ ID NO:218), or (b) the complement of the DNA of (a).

In a further aspect, the invention concerns an isolated nucleic acid molecule having at least 260 nucleotides and produced by hybridizing a test DNA molecule under stringent conditions with (a) a DNA molecule encoding a PRO1327 polypeptide having the sequence of amino acid residues from 1 or about 15 to about 252, inclusive of FIG. 124 (SEQ ID NO:218), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1327 polypeptide, with or without the N-terminal signal sequence and/or the initiating methionine, or is complementary to such encoding nucleic acid molecule. The signal peptide has been tentatively identified as extending from about amino acid position 1 to about amino acid position 14 in the sequence of FIG. 124 (SEQ ID NO:218).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 15 to about 252, inclusive of FIG. 124 (SEQ ID NO:218), or (b) the complement of the DNA of (a).

Another embodiment is directed to fragments of a PRO1327 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 123 (SEQ ID NO:217).

In another embodiment, the invention provides isolated PRO1327 polypeptide encoded by any of the isolated nucleic acid sequences hereinabove identified.

In a specific aspect, the invention provides isolated native sequence PRO1327 polypeptide, which in certain embodiments, includes an amino acid sequence comprising residues 1 or about 15 to about 252 of FIG. 124 (SEQ ID NO:218).

In another aspect, the invention concerns an isolated PRO1327 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 15 to about 252, inclusive of FIG. 124 (SEQ ID NO:218).

In a further aspect, the invention concerns an isolated PRO1327 polypeptide, comprising an amino acid sequence scoring at least about 80% positives, preferably at least about 85% positives, more preferably at least about 90% positives, most preferably at least about 95% positives when compared with the amino acid sequence of residues 1 or about 15 to about 252, inclusive of FIG. 124 (SEQ ID NO:218).

In yet another aspect, the invention concerns an isolated PRO1327 polypeptide, comprising the sequence of amino acid residues 1 or about 15 to about 252, inclusive of FIG. 124 (SEQ ID NO:218), or a fragment thereof sufficient to provide a binding site for an anti-PRO1327 antibody. Preferably, the PRO1327 fragment retains a qualitative biological activity of a native PRO1327 polypeptide.

In a still further aspect, the invention provides a polypeptide produced by (i) hybridizing a test DNA molecule under stringent conditions with (a) a DNA molecule encoding a PRO1327 polypeptide having the sequence of amino acid residues from about 1 or about 15 to about 252, inclusive of FIG. 124 (SEQ ID NO:218), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1327 polypeptide. In a particular embodiment, the agonist or antagonist is an anti-PRO1327 antibody.

In a further embodiment, the invention concerns a method of identifying agonists or antagonists of a native PRO1327 polypeptide by contacting the native PRO1327 polypeptide with a candidate molecule and monitoring a biological activity mediated by said polypeptide.

In a still further embodiment, the invention concerns a composition comprising a PRO1327 polypeptide, or an agonist or antagonist as hereinabove defined, in combination with a pharmaceutically acceptable carrier.

63. PRO1382

A cDNA clone (DNA66526-1616) has been identified that encodes a novel polypeptide having homology to cerebellin and designated in the present application as "PRO1382."

In one embodiment, the invention provides an isolated nucleic acid molecule comprising DNA encoding a PRO1382 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1382 polypeptide having the sequence of amino acid residues from 1 or about 28 to about 201, inclusive of FIG. 126 (SEQ ID NO:220), or (b) the complement of the DNA molecule of (a).

In another aspect, the invention concerns an isolated nucleic acid molecule encoding a PRO1382 polypeptide comprising DNA hybridizing to the complement of the nucleic acid between about residues 418 and about 939, inclusive, of FIG. 125 (SEQ ID NO:219). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203246 (DNA66526-1616), or (b) the complement of the DNA molecule of (a). In a preferred embodiment, the nucleic acid comprises a DNA encoding the same mature polypeptide encoded by the human protein cDNA in ATCC Deposit No. 203246 (DNA66526-1616).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 28 to about 201, inclusive of FIG. 126 (SEQ ID NO:220), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1382 polypeptide having the sequence of amino acid residues from about 28 to about 201, inclusive of FIG. 126 (SEQ ID NO:220), or the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1382 polypeptide, with or without the N-terminal signal sequence, or is complementary to such encoding nucleic acid molecule. The signal peptide has been tentatively identified as extending from amino acid position 1 through about amino acid position 27 in the sequence of FIG. 126 (SEQ ID NO:220).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 28 to about 201, inclusive of FIG. 126 (SEQ ID NO:220), or (b) the complement of the DNA of (a).

Another embodiment is directed to fragments of a PRO1382 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1382 polypeptide encoded by any of the isolated nucleic acid sequences hereinabove defined.

In a specific aspect, the invention provides isolated native sequence PRO1382 polypeptide, which in one embodiment, includes an amino acid sequence comprising residues 28 to 201 of FIG. 126 (SEQ ID NO:220).

In another aspect, the invention concerns an isolated PRO1382 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 28 to about 201, inclusive of FIG. 126 (SEQ ID NO:220).

In a further aspect, the invention concerns an isolated PRO1382 polypeptide, comprising an amino acid sequence scoring at least about 80% positives, preferably at least about 85% positives, more preferably at least about 90% positives, most preferably at least about 95% positives when compared with the amino acid sequence of residues 28 to 201 of FIG. 126 (SEQ ID NO:220).

In yet another aspect, the invention concerns anisolatedPRO1382polypeptide, comprising the sequence of amino acid residues 28 to about 201, inclusive of FIG. 126 (SEQ ID NO:220), or a fragment thereof sufficient to provide a binding site for an anti-PRO1382 antibody. Preferably, the PRO1382 fragment retains a qualitative biological activity of a native PRO1382 polypeptide.

In a still further aspect, the invention provides a polypeptide produced by (i) hybridizing a test DNA molecule under stringent conditions with (a) a DNA molecule encoding a PRO1382 polypeptide having the sequence of amino acid residues from about 28 to about 201, inclusive of FIG. 126 (SEQ ID NO:220), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1382 polypeptide. In a particular embodiment, the agonist or antagonist is an anti-PRO1382 antibody.

In a further embodiment, the invention concerns a method of identifying agonists or antagonists of a native PRO1382 polypeptide, by contacting the native PRO1382 polypeptide with a candidate molecule and monitoring a biological activity mediated by said polypeptide.

In a still further embodiment, the invention concerns a composition comprising a PRO1382 polypeptide, or an agonist or antagonist as hereinabove defined, in combination with a pharmaceutically acceptable carrier.

64. PRO1328

A cDNA clone (DNA66658-1584) has been identified that encodes a novel transmembrane polypeptide, designated in the present application as "PRO1328".

In one embodiment, the invention provides an isolated nucleic acid molecule comprising DNA encoding a PRO1328 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1328 polypeptide having the sequence of amino acid residues from about 1 or about 20 to about 257, inclusive of FIG. 128 (SEQ ID NO:225), or (b) the complement of the DNA molecule of (a).

In another aspect, the invention concerns an isolated nucleic acid molecule encoding a PRO1328 polypeptide comprising DNA hybridizing to the complement of the nucleic acid between about nucleotides 9 or about 66 and about 779, inclusive, of FIG. 127 (SEQ ID NO:224). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203229 (DNA66658-1584) or (b) the complement of the nucleic acid molecule of (a). In a preferred embodiment, the nucleic acid comprises a DNA encoding the same mature polypeptide encoded by the human protein cDNA in ATCC Deposit No. 203229 (DNA66658-1584).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 20 to about 257, inclusive of FIG. 128 (SEQ ID NO:225), or (b) the complement of the DNA of (a).

In a further aspect, the invention concerns an isolated nucleic acid molecule having at least 475 nucleotides and produced by hybridizing a test DNA molecule under stringent conditions with (a) a DNA molecule encoding a PRO1328 polypeptide having the sequence of amino acid residues from 1 or about 20 to about 257, inclusive of FIG. 128 (SEQ ID NO:225), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1328 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 19 in the sequence of FIG. 128 (SEQ ID NO:225). The transmembrane domains have been tentatively identified as extending from about amino acid position 32 to about amino acid position 51, from about amino acid position 119 to about amino acid position 138, from about amino acid position 152 to about amino acid position 169 and from about amino acid position 216 to about amino acid position 235 in the PRO1328 amino acid sequence (FIG. 128, SEQ ID NO:225).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 20 to about 257, inclusive of FIG. 128 (SEQ ID NO:225), or (b) the complement of the DNA of (a).

Another embodiment is directed to fragments of a PRO1328 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 127 (SEQ ID NO:224).

In another embodiment, the invention provides isolated PRO1328 polypeptide encoded by any of the isolated nucleic acid sequences hereinabove identified.

In a specific aspect, the invention provides isolated native sequence PRO1328 polypeptide, which in certain embodiments, includes an amino acid sequence comprising residues 1 or about 20 to about 257 of FIG. 128 (SEQ ID NO:225).

In another aspect, the invention concerns an isolated PRO1328 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 20 to about 257, inclusive of FIG. 128 (SEQ ID NO:225).

In a further aspect, the invention concerns an isolated PRO1328 polypeptide, comprising an amino acid sequence scoring at least about 80% positives, preferably at least about 85% positives, more preferably at least about 90% positives, most preferably at least about 95% positives when compared with the amino acid sequence of residues 1 or about 20 to about 257, inclusive of FIG. 128 (SEQ ID NO:225).

In yet another aspect, the invention concerns an isolated PRO1328 polypeptide, comprising the sequence of amino acid residues 1 or about 20 to about 257, inclusive of FIG. 128 (SEQ ID NO:225), or a fragment thereof sufficient to provide a binding site for an anti-PRO1328 antibody. Preferably, the PRO1328 fragment retains a qualitative biological activity of a native PRO1328 polypeptide.

In a still further aspect, the invention provides a polypeptide produced by (i) hybridizing a test DNA molecule under stringent conditions with (a) a DNA molecule encoding a PRO1328 polypeptide having the sequence of amino acid residues from about 1 or about 20 to about 257, inclusive of FIG. 128 (SEQ ID NO:225), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

65. PRO1325

A cDNA clone (DNA66659-1593) has been identified that encodes a novel transmembrane polypeptide, designated in the present application as "PRO1325".

In one embodiment, the invention provides an isolated nucleic acid molecule comprising DNA encoding a PRO1325 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1325 polypeptide having the sequence of amino acid residues from about 1 or about 19 to about 832, inclusive of FIG. 130 (SEQ ID NO:227), or (b) the complement of the DNA molecule of (a).

In another aspect, the invention concerns an isolated nucleic acid molecule encoding a PRO1325 polypeptide comprising DNA hybridizing to the complement of the nucleic acid between about nucleotides 51 or about 105 and about 2546, inclusive, of FIG. 129 (SEQ ID NO:226). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203269 (DNA66659-1593) or (b) the complement of the nucleic acid molecule of (a). In a preferred embodiment, the nucleic acid comprises a DNA encoding the same mature polypeptide encoded by the human protein cDNA in ATCC Deposit No. 203269 (DNA66659-1593).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 19 to about 832, inclusive of FIG. 130 (SEQ ID NO:227), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1325 polypeptide having the sequence of amino acid residues from 1 or about 19 to about 832, inclusive of FIG. 130 (SEQ ID NO:227), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1325 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 18 in the sequence of FIG. 130 (SEQ ID NO:227). The transmembrane domains have been tentatively identified as extending from about amino acid position 292 to about amino acid position 317, from about amino acid position 451 to about amino acid position 470, from about amino acid position 501 to about amino acid position 520, from about amino acid position 607 to about amino acid position 627 and from about amino acid position 751 to about amino acid position 770 in the PRO1325 amino acid sequence (FIG. 130, SEQ ID NO:227).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 19 to about 832, inclusive of FIG. 130 (SEQ ID NO:227), or (b) the complement of the DNA of (a).

Another embodiment is directed to fragments of a PRO1325 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 129 (SEQ ID NO:226).

In another embodiment, the invention provides isolated PRO1325 polypeptide encoded by any of the isolated nucleic acid sequences hereinabove identified.

In a specific aspect, the invention provides isolated native sequence PRO1325 polypeptide, which in certain embodiments, includes an amino acid sequence comprising residues 1 or about 19 to about 832 of FIG. 130 (SEQ ID NO:227).

In another aspect, the invention concerns an isolated PRO1325 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 19 to about 832, inclusive of FIG. 130 (SEQ ID NO:227).

In a further aspect, the invention concerns an isolated PRO1325 polypeptide, comprising an amino acid sequence scoring at least about 80% positives, preferably at least about 85% positives, more preferably at least about 90% positives, most preferably at least about 95% positives when compared with the amino acid sequence of residues 1 or about 19 to about 832, inclusive of FIG. 130 (SEQ ID NO:227).

In yet another aspect, the invention concerns an isolated PRO1325 polypeptide, comprising the sequence of amino acid residues 1 or about 19 to about 832, inclusive of FIG. 130 (SEQ ID NO:227), or a fragment thereof sufficient to provide a binding site for an anti-PRO1325 antibody. Preferably, the PRO1325 fragment retains a qualitative biological activity of a native PRO1325 polypeptide.

In a still further aspect, the invention provides a polypeptide produced by (i) hybridizing a test DNA molecule under stringent conditions with (a) a DNA molecule encoding a PRO1325 polypeptide having the sequence of amino acid residues from about 1 or about 19 to about 832, inclusive of FIG. 130 (SEQ ID NO:227), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

66. PRO1340

A cDNA clone (DNA66663-1598) has been identified that encodes a novel polypeptide having homology to Ksp-cadherin and designated in the present application as "PRO1340."

In one embodiment, the invention provides an isolated nucleic acid molecule comprising DNA encoding a PRO1340 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1340 polypeptide having the sequence of amino acid residues from 1 or about 19 to about 807, inclusive of FIG. 132 (SEQ ID NO:229), or (b) the complement of the DNA molecule of (a).

In another aspect, the invention concerns an isolated nucleic acid molecule encoding a PRO1340 polypeptide comprising DNA hybridizing to the complement of the nucleic acid between about residues 182 and about 2548, inclusive, of FIG. 131 (SEQ ID NO:228). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203268 (DNA66663-1598), or (b) the complement of the DNA molecule of (a). In a preferred embodiment, the nucleic acid comprises a DNA encoding the same mature polypeptide encoded by the human protein cDNA in ATCC Deposit No. 203268 (DNA66663-1598).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 807, inclusive of FIG. 132 (SEQ ID NO:229), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1340 polypeptide having the sequence of amino acid residues from about 19 to about 807, inclusive of FIG. 132 (SEQ ID NO:229), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1340 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 18 in the sequence of FIG. 132 (SEQ ID NO:229). The transmembrane domain has been tentatively identified as extending from about amino acid position 762 to about amino acid position 784 in the PRO1340 amino acid sequence (FIG. 132, SEQ ID NO:229).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 807, inclusive of FIG. 132 (SEQ ID NO:229), or (b) the complement of the DNA of (a).

Another embodiment is directed to fragments of a PRO1340 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1340 polypeptide encoded by any of the isolated nucleic acid sequences hereinabove defined.

In a specific aspect, the invention provides isolated native sequence PRO1340 polypeptide, which in one embodiment, includes an amino acid sequence comprising residues 19 to 807 of FIG. 132 (SEQ ID NO:229).

In another aspect, the invention concerns an isolated PRO1340 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 807, inclusive of FIG. 132 (SEQ ID NO:229).

In a further aspect, the invention concerns an isolated PRO1340 polypeptide, comprising an amino acid sequence scoring at least about 80% positives, preferably at least about 85% positives, more preferably at least about 90% positives, most preferably at least about 95% positives when compared with the amino acid sequence of residues 19 to 807 of FIG. 132 (SEQ ID NO:229).

In yet another aspect, the invention concerns an isolated PRO1340 polypeptide, comprising the sequence of amino acid residues 19 to about 807, inclusive of FIG. 132 (SEQ ID NO:229), or a fragment thereof sufficient to provide a binding site for an anti-PRO1340 antibody. Preferably, the PRO1340 fragment retains a qualitative biological activity of a native PRO1340 polypeptide.

In a still further aspect, the invention provides a polypeptide produced by (i) hybridizing a test DNA molecule under stringent conditions with (a) a DNA molecule encoding a PRO1340 polypeptide having the sequence of amino acid residues from about 19 to about 807, inclusive of FIG. 132 (SEQ ID NO:229), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1340 polypeptide. In a particular embodiment, the agonist or antagonist is an anti-PRO1340 antibody.

In a further embodiment, the invention concerns a method of identifying agonists or antagonists of a native PRO1340 polypeptide, by contacting the native PRO1340 polypeptide with a candidate molecule and monitoring a biological activity mediated by said polypeptide.

In a still further embodiment, the invention concerns a composition comprising a PRO1340 polypeptide, or an agonist or antagonist as hereinabove defined, in combination with a pharmaceutically acceptable carrier.

67. PRO1339

A cDNA clone (DNA66669-1597) has been identified that encodes a novel polypeptide having sequence identity with carboxypepsidases and designated in the present application as "PRO1339."

In one embodiment, the invention provides an isolated nucleic acid molecule comprising DNA encoding a PRO1339 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1339 polypeptide having the sequence of amino acid residues from 1 or about 17 to about 421, inclusive of FIG. 134 (SEQ ID NO:234), or (b) the complement of the DNA molecule of (a).

In another aspect, the invention concerns an isolated nucleic acid molecule encoding a PRO1339 polypeptide comprising DNA hybridizing to the complement of the nucleic acid between about residues 58 and about 1271, inclusive, of FIG. 133 (SEQ ID NO:233). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203272 (DNA66669-1597), or (b) the complement of the DNA molecule of (a). In a preferred embodiment, the nucleic acid comprises a DNA encoding the same mature polypeptide encoded by the human protein cDNA in ATCC Deposit No. 203272 (DNA66669-1597).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 17 to about 421, inclusive of FIG. 134 (SEQ ID NO:234), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1339 polypeptide having the sequence of amino acid residues from about 17 to about 421, inclusive of FIG. 134 (SEQ ID NO:234), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 17 to about 421, inclusive of FIG. 134 (SEQ ID NO:234), or (b) the complement of the DNA of (a).

Another embodiment is directed to fragments of a PRO1339 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1339 polypeptide encoded by any of the isolated nucleic acid sequences hereinabove defined.

In a specific aspect, the invention provides isolated native sequence PRO1339 polypeptide, which in one embodiment, includes an amino acid sequence comprising residues 17 through 421 of FIG. 134 (SEQ ID NO:234).

In another aspect, the invention concerns an isolated PRO1339 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 17 to about 421, inclusive of FIG. 134 (SEQ ID NO:234).

In a further aspect, the invention concerns an isolated PRO1339 polypeptide, comprising an amino acid sequence scoring at least about 80% positives, preferably at least about 85% positives, more preferably at least about 90% positives, most preferably at least about 95% positives when compared with the amino acid sequence of residues 17 through 421 of FIG. 134 (SEQ ID NO:234).

In yet another aspect, the invention concerns an isolated PRO1339 polypeptide, comprising the sequence of amino acid residues 17 to about 421, inclusive of FIG. 134 (SEQ ID NO:234), or a fragment thereof sufficient to provide a binding site for an anti-PRO1339 antibody. Preferably, the PRO1339 fragment retains a qualitative biological activity of a native PRO1339 polypeptide.

In a still further aspect, the invention provides a polypeptide produced by (i) hybridizing a test DNA molecule under stringent conditions with (a) a DNA molecule encoding a PRO1339 polypeptide having the sequence of amino acid residues from about 17 to about 421, inclusive of FIG. 134 (SEQ ID NO:234), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1339 polypeptide. In a particular embodiment, the agonist or antagonist is an anti-PRO1339 antibody.

In a further embodiment, the invention concerns a method of identifying agonists or antagonists of a native PRO1339 polypeptide, by contacting the native PRO1339 polypeptide with a candidate molecule and monitoring a biological activity mediated by said polypeptide.

In a still further embodiment, the invention concerns a composition comprising a PRO1339 polypeptide, or an agonist or antagonist as hereinabove defined, in combination with a pharmaceutically acceptable carrier.

68. PRO1337

A cDNA clone (DNA66672-1586) has been identified that encodes a novel polypeptide having homology to human thyroxine-binding globulin designated in the present application as "PRO1337".

In one embodiment, the invention provides an isolated nucleic acid molecule comprising DNA encoding a PRO1337 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1337 polypeptide having the sequence of amino acid residues from 1 or about 21 to about 417, inclusive of FIG. 136 (SEQ ID NO:236), or (b) the complement of the DNA molecule of (a).

In another aspect, the invention concerns an isolated nucleic acid molecule encoding a PRO1337 polypeptide comprising DNA hybridizing to the complement of the nucleic acid between about residues 120 and about 1310, inclusive, of FIG. 135 (SEQ ID NO:235). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203265 (DNA66672-66672), or (b) the complement of the DNA molecule of (a). In a preferred embodiment, the nucleic acid comprises a DNA encoding the same mature polypeptide encoded by the human protein cDNA in ATCC Deposit No. 203265 (DNA66672-66672).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 417, inclusive of FIG. 136 (SEQ ID NO:236), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1337 polypeptide having the sequence of amino acid residues from about 21 to about 417, inclusive of FIG. 136 (SEQ ID NO:236), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1337 polypeptide, with or without the N-terminal signal sequence and/or the initiating methionine, or is complementary to such encoding nucleic acid molecule. The signal peptide has been tentatively identified as extending from amino acid position 1 through about amino acid position 20 in the sequence of FIG. 136 (SEQ ID NO:236).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 417, inclusive of FIG. 136 (SEQ ID NO:236), or (b) the complement of the DNA of (a).

Another embodiment is directed to fragments of a PRO1337 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1337 polypeptide encoded by any of the isolated nucleic acid sequences hereinabove defined.

In a specific aspect, the invention provides isolated native sequence PRO1337 polypeptide, which in one embodiment, includes an amino acid sequence comprising residues 21 to 417 of FIG. 136 (SEQ ID NO:236).

In another aspect, the invention concerns an isolated PRO1337 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 417, inclusive of FIG. 136 (SEQ ID NO:236).

In a further aspect, the invention concerns an isolated PRO1337 polypeptide, comprising an amino acid sequence scoring at least about 80% positives, preferably at least about 85% positives, more preferably at least about 90% positives, most preferably at least about 95% positives when compared with the amino acid sequence of residues 21 to 417 of FIG. 136 (SEQ ID NO:236).

In yet another aspect, the invention concerns an isolated PRO1337 polypeptide, comprising the sequence of amino acid residues 21 to about 417, inclusive of FIG. 136 (SEQ ID NO:236), or a fragment thereof sufficient to provide a binding site for an anti-PRO1337 antibody. Preferably, the PRO1337 fragment retains a qualitative biological activity of a native PRO1337 polypeptide.

In a still further aspect, the invention provides a polypeptide produced by (i) hybridizing a test DNA molecule under stringent conditions with (a) a DNA molecule encoding a PRO1337 polypeptide having the sequence of amino acid residues from about 21 to about 417, inclusive of FIG. 136 (SEQ ID NO:236), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1337 polypeptide. In a particular embodiment, the agonist or antagonist is an anti-PRO1337 antibody.

In a further embodiment, the invention concerns a method of identifying agonists or antagonists of a native PRO1337 polypeptide, by contacting the native PRO1337 polypeptide with a candidate molecule and monitoring a biological activity mediated by said polypeptide.

In a still further embodiment, the invention concerns a composition comprising a PRO1337 polypeptide, or an agonist or antagonist as hereinabove defined, in combination with a pharmaceutically acceptable carrier.

69. PRO1342

A cDNA clone (DNA66674-1599) has been identified that encodes a novel transmembrane polypeptide designated in the present application as "PRO1342".

In one embodiment, the invention provides an isolated nucleic acid molecule comprising DNA encoding a PRO1342 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1342 polypeptide having the sequence of amino acid residues from 1 or about 21 to about 596, inclusive of FIG. 138 (SEQ ID NO:243), or (b) the complement of the DNA molecule of (a).

In another aspect, the invention concerns an isolated nucleic acid molecule encoding a PRO1342 polypeptide comprising DNA hybridizing to the complement of the nucleic acid between about residues 299 and about 2026, inclusive, of FIG. 137 (SEQ ID NO:242). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203281 (DNA66674-1599), or (b) the complement of the DNA molecule of (a). In a preferred embodiment, the nucleic acid comprises a DNA encoding the same mature polypeptide encoded by the human protein cDNA in ATCC Deposit No. 203281 (DNA66674-1599).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 596, inclusive of FIG. 138 (SEQ ID NO:243), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1342 polypeptide having the sequence of amino acid residues from about 21 to about 596, inclusive of FIG. 138 (SEQ ID NO:243), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1342 polypeptide, with or without the N-terminal signal sequence and/or the initiating methionine, and its soluble variants (i.e. transmembrane domain deleted or inactivated), or is complementary to such encoding nucleic acid molecule. The signal peptide has been tentatively identified as extending from amino acid position 1 through about amino acid position 20 in the sequence of FIG. 138 (SEQ ID NO:243). The transmembrane domain has been tentatively identified as extending from about amino acid position 510 to about amino acid position 532 in the PRO1342 amino acid sequence (FIG. 138, SEQ ID NO:243).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 596, inclusive of FIG. 138 (SEQ ID NO:243), or (b) the complement of the DNA of (a).

Another embodiment is directed to fragments of a PRO1342 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1342 polypeptide encoded by any of the isolated nucleic acid sequences hereinabove defined.

In a specific aspect, the invention provides isolated native sequence PRO1342 polypeptide, which in one embodiment, includes an amino acid sequence comprising residues 21 to 596 of FIG. 138 (SEQ ID NO:243).

In another aspect, the invention concerns an isolated PRO1342 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 596, inclusive of FIG. 138 (SEQ ID NO:243).

In a further aspect, the invention concerns an isolated PRO1342 polypeptide, comprising an amino acid sequence scoring at least about 80% positives, preferably at least about 85% positives, more preferably at least about 90% positives, most preferably at least about 95% positives when compared with the amino acid sequence of residues 21 to 596 of FIG. 138 (SEQ ID NO:243).

In yet another aspect, the invention concerns an isolated PRO1342 polypeptide, comprising the sequence of amino acid residues 21 to about 596, inclusive of FIG. 138 (SEQ ID NO:243), or a fragment thereof sufficient to provide a binding site for an anti-PRO1342 antibody. Preferably, the PRO1342 fragment retains a qualitative biological activity of a native PRO1342 polypeptide.

In a still further aspect, the invention provides a polypeptide produced by (i) hybridizing a test DNA molecule under stringent conditions with (a) a DNA molecule encoding a PRO1342 polypeptide having the sequence of amino acid residues from about 21 to about 596, inclusive of FIG. 138 (SEQ ID NO:243), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

70. PRO1343

A cDNA clone (DNA66675-1587) has been identified that encodes a novel secreted polypeptide, designated in the present application as "PRO1343".

In one embodiment, the invention provides an isolated nucleic acid molecule comprising DNA encoding a PRO1343 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1343 polypeptide having the sequence of amino acid residues from about 1 or about 26 to about 247, inclusive of FIG. 140 (SEQ ID NO:248), or (b) the complement of the DNA molecule of (a).

In another aspect, the invention concerns an isolated nucleic acid molecule encoding a PRO1343 polypeptide comprising DNA hybridizing to the complement of the nucleic acid between about nucleotides 71 or about 146 and about 811, inclusive, of FIG. 139 (SEQ ID NO:247). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203282 (DNA66675-1587) or (b) the complement of the nucleic acid molecule of (a). In a preferred embodiment, the nucleic acid comprises a DNA encoding the same mature polypeptide encoded by the human protein cDNA in ATCC Deposit No. 203282 (DNA66675-1587).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 247, inclusive of FIG. 140 (SEQ ID NO:248), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1343 polypeptide having the sequence of amino acid residues from 1 or about 26 to about 247, inclusive of FIG. 140 (SEQ ID NO:248), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1343 polypeptide, with or without the N-terminal signal sequence and/or the initiating methionine, or is complementary to such encoding nucleic acid molecule. The signal peptide has been tentatively identified as extending from about amino acid position 1 to about amino acid position 25 in the sequence of FIG. 140 (SEQ ID NO:248).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 247, inclusive of FIG. 140 (SEQ ID NO:248), or (b) the complement of the DNA of (a).

Another embodiment is directed to fragments of a PRO1343 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 139 (SEQ ID NO:247).

In another embodiment, the invention provides isolated PRO1343 polypeptide encoded by any of the isolated nucleic acid sequences hereinabove identified.

In a specific aspect, the invention provides isolated native sequence PRO1343 polypeptide, which in certain embodiments, includes an amino acid sequence comprising residues 1 or about 26 to about 247 of FIG. 140 (SEQ ID NO:248).

In another aspect, the invention concerns an isolated PRO1343 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 247, inclusive of FIG. 140 (SEQ ID NO:248).

In a further aspect, the invention concerns an isolated PRO1343 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 247, inclusive of FIG. 140 (SEQ ID NO:248).

In yet another aspect, the invention concerns an isolated PRO1343 polypeptide, comprising the sequence of amino acid residues 1 or about 26 to about 247, inclusive of FIG. 140 (SEQ ID NO:248), or a fragment thereof sufficient to provide a binding site for an anti-PRO1343 antibody. Preferably, the PRO1343 fragment retains a qualitative biological activity of a native PRO1343 polypeptide.

In a still further aspect, the invention provides a polypeptide produced by (i) hybridizing a test DNA molecule under stringent conditions with (a) a DNA molecule encoding a PRO1343 polypeptide having the sequence of amino acid residues from about 1 or about 26 to about 247, inclusive of FIG. 140 (SEQ ID NO:248), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

71. PRO1480

A cDNA clone (DNA67962-1649) has been identified that encodes a novel polypeptide having homology to Semaphorin C and designated in the present application as "PRO1480."

In one embodiment, the invention provides an isolated nucleic acid molecule comprising DNA encoding a PRO1480 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1480 polypeptide having the sequence of amino acid residues from about 1 to about 837, inclusive of FIG. 142 (SEQ ID NO:253), or (b) the complement of the DNA molecule of (a).

In another aspect, the invention concerns an isolated nucleic acid molecule encoding a PRO1480 polypeptide comprising DNA hybridizing to the complement of the nucleic acid between about residues 241 and about 2751, inclusive, of FIG. 141 (SEQ ID NO:252). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203291 (DNA67962-1649), or (b) the complement of the DNA molecule of (a). In a preferred embodiment, the nucleic acid comprises a DNA encoding the same mature polypeptide encoded by the human protein cDNA in ATCC Deposit No. 203291 (DNA67962-1649).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 837, inclusive of FIG. 142 (SEQ ID NO:253), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1480 polypeptide having the sequence of amino acid residues from about 1 to about 837, inclusive of FIG. 142 (SEQ ID NO:253), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1480 polypeptide, its soluble variants, (i.e. transmembrane domains deleted or inactivated) or is complementary to such encoding nucleic acid molecule. Transmembrane domains have been tentatively identified as extending from about amino acid position 23 to about amino acid position 46 (type II) and about amino acid position 718 to about amino acid position 738 in the PRO1480 amino acid sequence (FIG. 142, SEQ ID NO:253).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 837, inclusive of FIG. 142 (SEQ ID NO:253), or (b) the complement of the DNA of (a).

Another embodiment is directed to fragments of a PRO1480 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1480 polypeptide encoded by any of the isolated nucleic acid sequences hereinabove defined.

In a specific aspect, the invention provides isolated native sequence PRO1480 polypeptide, which in one embodiment, includes an amino acid sequence comprising residues 1 to 837 of FIG. 142 (SEQ ID NO:253).

In another aspect, the invention concerns an isolated PRO1480 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 837, inclusive of FIG. 142 (SEQ ID NO:253).

In a further aspect, the invention concerns an isolated PRO1480 polypeptide, comprising an amino acid sequence scoring at least about 80% positives, preferably at least about 85% positives, more preferably at least about 90% positives, most preferably at least about 95% positives when compared with the amino acid sequence of residues 1 to 837 of FIG. 142 (SEQ ID NO:253).

In yet another aspect, the invention concerns an isolated PRO1480 polypeptide, comprising the sequence of amino acid residues 1 to about 837, inclusive of FIG. 142 (SEQ ID NO:253), or a fragment thereof sufficient to provide a binding site for an anti-PRO1480 antibody. Preferably, the PRO1480 fragment retains a qualitative biological activity of a native PRO1480 polypeptide.

In a still further aspect, the invention provides a polypeptide produced by (i) hybridizing a test DNA molecule under stringent conditions with (a) a DNA molecule encoding a PRO1480 polypeptide having the sequence of amino acid residues from about 1 to about 837, inclusive of FIG. 142 (SEQ ID NO:253), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1480 polypeptide. In a particular embodiment, the agonist or antagonist is an anti-PRO1480 antibody.

In a further embodiment, the invention concerns a method of identifying agonists or antagonists of a native PRO1480 polypeptide, by contacting the native PRO1480 polypeptide with a candidate molecule and monitoring a biological activity mediated by said polypeptide.

In a still further embodiment, the invention concerns a composition comprising a PRO1480 polypeptide, or an agonist or antagonist as hereinabove defined, in combination with a pharmaceutically acceptable carrier.

72. PRO1487

A cDNA clone (DNA68836-1656) has been identified that encodes a novel polypeptide having homology to fringe protein and designated in the present application as "PRO1487".

In one embodiment, the invention provides an isolated nucleic acid molecule comprising DNA encoding a PRO1487 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1487 polypeptide having the sequence of amino acid residues from 1 or about 24 to about 802, inclusive of FIG. 144 (SEQ ID NO:260), or (b) the complement of the DNA molecule of (a).

In another aspect, the invention concerns an isolated nucleic acid molecule encoding a PRO1487 polypeptide comprising DNA hybridizing to the complement of the nucleic acid between about residues 558 and about 2894, inclusive, of FIGS. 143A–B (SEQ ID NO:259). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203455 (DNA68836-1656), or (b) the complement of the DNA molecule of (a). In a preferred embodiment, the nucleic acid comprises a DNA encoding the same mature polypeptide encoded by the human protein cDNA in ATCC Deposit No. 203455 (DNA68836-1656).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 24 to about 802, inclusive of FIG. 144 (SEQ ID NO:260), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1487 polypeptide having the sequence of amino acid residues from about 24 to about 802, inclusive of FIG. 144 (SEQ ID NO:260), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1487 polypeptide, with or without the N-terminal signal sequence and/or the initiating, or is complementary to such encoding nucleic acid molecule. The signal peptide has been tentatively identified as extending from amino acid position 1 through about amino acid position 23 in the sequence of FIG. 144 (SEQ ID NO:260).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 24 to about 802, inclusive of FIG. 144 (SEQ ID NO:260), or (b) the complement of the DNA of (a).

Another embodiment is directed to fragments of a PRO1487 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1487 polypeptide encoded by any of the isolated nucleic acid sequences hereinabove defined.

In a specific aspect, the invention provides isolated native sequence PRO1487 polypeptide, which in one embodiment, includes an amino acid sequence comprising residues 24 to 802 of FIG. 144 (SEQ ID NO:260).

In another aspect, the invention concerns an isolated PRO1487 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 24 to about 802, inclusive of FIG. 144 (SEQ ID NO:260).

In a further aspect, the invention concerns an isolated PRO1487 polypeptide, comprising an amino acid sequence scoring at least about 80% positives, preferably at least about 85% positives, more preferably at least about 90% positives, most preferably at least about 95% positives when compared with the amino acid sequence of residues 24 to 802 of FIG. 144 (SEQ ID NO:260).

In yet another aspect, the invention concerns an isolated PRO1487 polypeptide, comprising the sequence of amino acid residues 24 to about 802, inclusive of FIG. 144 (SEQ ID NO:260), or a fragment thereof sufficient to provide a binding site for an anti-PRO1487 antibody. Preferably, the PRO1487 fragment retains a qualitative biological activity of a native PRO1487 polypeptide.

In a still further aspect, the invention provides a polypeptide produced by (i) hybridizing a test DNA molecule under stringent conditions with (a) a DNA molecule encoding a PRO1487 polypeptide having the sequence of amino acid residues from about 24 to about 802, inclusive of FIG. 144 (SEQ ID NO:260), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1487 polypeptide. In a particular embodiment, the agonist or antagonist is an anti-PRO1487 antibody.

In a further embodiment, the invention concerns a method of identifying agonists or antagonists of a native PRO1487 polypeptide, by contacting the native PRO1487 polypeptide with a candidate molecule and monitoring a biological activity mediated by said polypeptide.

In a still further embodiment, the invention concerns a composition comprising a PRO1487 polypeptide, or an agonist or antagonist as hereinabove defined, in combination with a pharmaceutically acceptable carrier.

73. PRO1418

A cDNA clone (DNA68864-1629) has been identified that encodes a novel secreted polypeptide designated in the present application as "PRO1418."

In one embodiment, the invention provides an isolated nucleic acid molecule comprising DNA encoding a PRO1418 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1418 polypeptide having the sequence of amino acid residues from 1 or about 20 to about 350, inclusive of FIG. 146 (SEQ ID NO:265), or (b) the complement of the DNA molecule of (a).

In another aspect, the invention concerns an isolated nucleic acid molecule encoding a PRO1418 polypeptide comprising DNA hybridizing to the complement of the nucleic acid between about residues 195 and about 1187, inclusive, of FIG. 145 (SEQ ID NO:264). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203276 (DNA68864-1629), or (b) the complement of the DNA molecule of (a). In a preferred embodiment, the nucleic acid comprises a DNA encoding the same mature polypeptide encoded by the human protein cDNA in ATCC Deposit No. 203276 (DNA68864-1629).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 350, inclusive of FIG. 146 (SEQ ID NO:265), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1418 polypeptide having the sequence of amino acid residues from about 20 to about 350, inclusive of FIG. 146 (SEQ ID NO:265), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 350, inclusive of FIG. 146 (SEQ ID NO:265), or (b) the complement of the DNA of (a).

Another embodiment is directed to fragments of a PRO1418 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1418 polypeptide encoded by any of the isolated nucleic acid sequences hereinabove defined.

In a specific aspect, the invention provides isolated native sequence PRO1418 polypeptide, which in one embodiment, includes an amino acid sequence comprising residues 20 through 350 of FIG. 146 (SEQ ID NO:265).

In another aspect, the invention concerns an isolated PRO1418 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 350, inclusive of FIG. 146 (SEQ ID NO:265).

In a further aspect, the invention concerns an isolated PRO1418 polypeptide, comprising an amino acid sequence scoring at least about 80% positives, preferably at least about 85% positives, more preferably at least about 90% positives, most preferably at least about 95% positives when compared with the amino acid sequence of residues 20 through 350 of FIG. 146 (SEQ ID NO:265).

In yet another aspect, the invention concerns an isolated PRO1418 polypeptide, comprising the sequence of amino acid residues 20 to about 350, inclusive of FIG. 146 (SEQ ID NO:265), or a fragment thereof sufficient to provide a binding site for an anti-PRO1418 antibody. Preferably, the PRO1418 fragment retains a qualitative biological activity of a native PRO1418 polypeptide.

In a still further aspect, the invention provides a polypeptide produced by (i) hybridizing a test DNA molecule under stringent conditions with (a) a DNA molecule encoding a PRO1418 polypeptide having the sequence of amino acid residues from about 20 to about 350, inclusive of FIG. 146 (SEQ ID NO:265), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1418 polypeptide. In a particular embodiment, the agonist or antagonist is an anti-PRO1418 antibody.

In a further embodiment, the invention concerns a method of identifying agonists or antagonists of a native PRO1418 polypeptide, by contacting the native PRO1418 polypeptide with a candidate molecule and monitoring a biological activity mediated by said polypeptide.

In a still further embodiment, the invention concerns a composition comprising a PRO1418 polypeptide, or an agonist or antagonist as hereinabove defined, in combination with a pharmaceutically acceptable carrier.

74. PRO1472

A cDNA clone (DNA68866-1644) has been identified that encodes a novel polypeptide having sequence identity with butyrophilin and designated in the present application as "PRO1472."

In one embodiment, the invention provides an isolated nucleic acid molecule comprising DNA encoding a PRO1472 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1472 polypeptide having the sequence of amino acid residues from 1 or about 18 to about 466, inclusive of FIG. 148 (SEQ ID NO:267), or (b) the complement of the DNA molecule of (a).

In another aspect, the invention concerns an isolated nucleic acid molecule encoding a PRO1472 polypeptide comprising DNA hybridizing to the complement of the nucleic acid between about residues 185 and about 1531, inclusive, of FIG. 147 (SEQ ID NO:266). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203283 (DNA68866-1644), or (b) the complement of the DNA molecule of (a). In a preferred embodiment, the nucleic acid comprises a DNA encoding the same mature polypeptide encoded by the human protein cDNA in ATCC Deposit No. 203283 (DNA68866-1644).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 466, inclusive of FIG. 148 (SEQ ID NO:267), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1472 polypeptide having the sequence of amino acid residues from about 18 to about 466, inclusive of FIG. 148 (SEQ ID NO:267), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1472 polypeptide, with or without the N-terminal signal sequence and/or the initiating methionine, and its soluble, i.e. transmembrane domains deleted or inactivated variants, or is complementary to such encoding nucleic acid molecule. The signal peptide has been tentatively identified as extending from amino acid position 1 through about amino acid position 1-17 in the sequence of FIG. 148 (SEQ ID NO:267). The transmembrane domains have been tentatively identified as being from about amino acid position 131 through about amino acid position 150 and from about amino acid position 235 through about amino acid position 259 in the PRO1472 amino acid sequence (FIG. 148, SEQ ID NO:267). It is understood that PRO1472 can be manipulated to contain only particular regions given the information herein, e.g. to have only the extracellular or cytoplasmic regions only, or to have the carboxyl end truncated wherein the second transmembrane domain is deleted.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 466, inclusive of FIG. 148 (SEQ ID NO:267), or (b) the complement of the DNA of (a).

Another embodiment is directed to fragments of a PRO1472 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1472 polypeptide encoded by any of the isolated nucleic acid sequences hereinabove defined.

In a specific aspect, the invention provides isolated native sequence PRO1472 polypeptide, which in one embodiment, includes an amino acid sequence comprising residues 18 through 466 of FIG. 148 (SEQ ID NO:267).

In another aspect, the invention concerns an isolated PRO1472 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 466, inclusive of FIG. 148 (SEQ ID NO:267).

In a further aspect, the invention concerns an isolated PRO1472 polypeptide, comprising an amino acid sequence scoring at least about 80% positives, preferably at least about 85% positives, more preferably at least about 90% positives, most preferably at least about 95% positives when compared with the amino acid sequence of residues 18 through 466 of FIG. 148 (SEQ ID NO:267).

In yet another aspect, the invention concerns an isolated PRO1472 polypeptide, comprising the sequence of amino acid residues 18 to about 466, inclusive of FIG. 148 (SEQ ID NO:267), or a fragment thereof sufficient to provide a binding site for an anti-PRO1472 antibody. Preferably, the PRO1472 fragment retains a qualitative biological activity of a native PRO1472 polypeptide.

In a still further aspect, the invention provides a polypeptide produced by (i) hybridizing a test DNA molecule under stringent conditions with (a) a DNA molecule encoding a PRO1472 polypeptide having the sequence of amino acid residues from about 18 to about 466, inclusive of FIG. 148 (SEQ ID NO:267), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1472 polypeptide. In a particular embodiment, the agonist or antagonist is an anti-PRO1472 antibody.

In a further embodiment, the invention concerns a method of identifying agonists or antagonists of a native PRO1472 polypeptide, by contacting the native PRO1472 polypeptide with a candidate molecule and monitoring a biological activity mediated by said polypeptide.

In a still further embodiment, the invention concerns a composition comprising a PRO1472 polypeptide, or an agonist or antagonist as hereinabove defined, in combination with a pharmaceutically acceptable carrier.

75. PRO1461

A cDNA clone (DNA68871-1638) has been identified that encodes a novel polypeptide having homology to serine protease and designated in the present application as "PRO1461".

In one embodiment, the invention provides an isolated nucleic acid molecule comprising DNA encoding a PRO1461 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1461 polypeptide having the sequence of amino acid residues from about 1 to about 423, inclusive of FIG. 150 (SEQ ID NO:269), or (b) the complement of the DNA molecule of (a).

In another aspect, the invention concerns an isolated nucleic acid molecule encoding a PRO1461 polypeptide comprising DNA hybridizing to the complement of the nucleic acid between about residues 32 and about 1300, inclusive, of FIG. 149 (SEQ ID NO:268). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203280 (DNA68871-68871), or (b) the complement of the DNA molecule of (a). In a preferred embodiment, the nucleic acid comprises a DNA encoding the same mature polypeptide encoded by the human protein cDNA in ATCC Deposit No. 203280 (DNA68871-68871).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 423, inclusive of FIG. 150 (SEQ ID NO:269), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1461 polypeptide having the sequence of amino acid residues from about 1 to about 423, inclusive of FIG. 150 (SEQ ID NO:269), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1461 polypeptide, with or without the initiating methionine, and its soluble variants (i.e. transmembrane domain deleted or inactivated), or is complementary to such encoding nucleic acid molecule. A type II transmembrane domain has been tentatively identified as extending from about amino acid position 21 to about amino acid position 40 in the PRO1461 amino acid sequence (FIG. 150, SEQ ID NO:269).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 423, inclusive of FIG. 150 (SEQ ID NO:269), or (b) the complement of the DNA of (a).

Another embodiment is directed to fragments of a PRO1461 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1461 polypeptide encoded by any of the isolated nucleic acid sequences hereinabove defined.

In a specific aspect, the invention provides isolated native sequence PRO1461 polypeptide, which in one embodiment, includes an amino acid sequence comprising residues 1 to 423 of FIG. 150 (SEQ ID NO:269).

In another aspect, the invention concerns an isolated PRO1461 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 423, inclusive of FIG. 150 (SEQ ID NO:269).

In a further aspect, the invention concerns an isolated PRO1461 polypeptide, comprising an amino acid sequence scoring at least about 80% positives, preferably at least about 85% positives, more preferably at least about 90% positives, most preferably at least about 95% positives when compared with the amino acid sequence of residues 1 to 423 of FIG. 150 (SEQ ID NO:269).

In yet another aspect, the invention concerns an isolated PRO1461 polypeptide, comprising the sequence of amino acid residues 1 to about 423, inclusive of FIG. 150 (SEQ ID NO:269), or a fragment thereof sufficient to provide a binding site for an anti-PRO1461 antibody. Preferably, the PRO1461 fragment retains a qualitative biological activity of a native PRO1461 polypeptide.

In a still further aspect, the invention provides a polypeptide produced by (i) hybridizing a test DNA molecule under stringent conditions with (a) a DNA molecule encoding a PRO1461 polypeptide having the sequence of amino acid residues from about 1 to about 423, inclusive of FIG. 150 (SEQ ID NO:269), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1461 polypeptide. In a particular embodiment, the agonist or antagonist is an anti-PRO1461 antibody.

In a further embodiment, the invention concerns a method of identifying agonists or antagonists of a native PRO1461 polypeptide, by contacting the native PRO1461 polypeptide with a candidate molecule and monitoring a biological activity mediated by said polypeptide.

In a still further embodiment, the invention concerns a composition comprising a PRO1461 polypeptide, or an agonist or antagonist as hereinabove defined, in combination with a pharmaceutically acceptable carrier.

76. PRO1410

A cDNA clone (DNA68874-1622) has been identified that encodes a novel transmembrane polypeptide, designated in the present application as "PRO1410".

In one embodiment, the invention provides an isolated nucleic acid molecule comprising DNA encoding a PRO1410 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1410 polypeptide having the sequence of amino acid residues from about 1 or about 21 to about 238, inclusive of FIG. 152 (SEQ ID NO:271), or (b) the complement of the DNA molecule of (a).

In another aspect, the invention concerns an isolated nucleic acid molecule encoding a PRO1410 polypeptide comprising DNA hybridizing to the complement of the nucleic acid between about nucleotides 152 or about 212 and about 865, inclusive, of FIG. 151 (SEQ ID NO:270). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203277 (DNA68874-1622) or (b) the complement of the nucleic acid molecule of (a). In a preferred embodiment, the nucleic acid comprises a DNA encoding the same mature polypeptide encoded by the human protein cDNA in ATCC Deposit No. 203277 (DNA68874-1622).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 21 to about 238, inclusive of FIG. 152 (SEQ ID NO:271), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1410 polypeptide having the sequence of amino acid residues from 1 or about 21 to about 238, inclusive of FIG. 152 (SEQ ID NO:271), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1410 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 20 in the sequence of FIG. 152 (SEQ ID NO:271). The transmembrane domain has been tentatively identified as extending from about amino acid position 194 to about amino acid position 220 in the PRO1410 amino acid sequence (FIG. 152, SEQ ID NO:271).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 21 to about 238, inclusive of FIG. 152 (SEQ ID NO:271), or (b) the complement of the DNA of (a).

Another embodiment is directed to fragments of a PRO1410 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 151 (SEQ ID NO:270).

In another embodiment, the invention provides isolated PRO1410 polypeptide encoded by any of the isolated nucleic acid sequences hereinabove identified.

In a specific aspect, the invention provides isolated native sequence PRO1410 polypeptide, which in certain embodiments, includes an amino acid sequence comprising residues 1 or about 21 to about 238 of FIG. 152 (SEQ ID NO:271).

In another aspect, the invention concerns an isolated PRO1410 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 21 to about 238, inclusive of FIG. 152 (SEQ ID NO:271).

In a further aspect, the invention concerns an isolated PRO1410 polypeptide, comprising an amino acid sequence scoring at least about 80% positives, preferably at least about 85% positives, more preferably at least about 90% positives, most preferably at least about 95% positives when compared with the amino acid sequence of residues 1 or about 21 to about 238, inclusive of FIG. 152 (SEQ ID NO:271).

In yet another aspect, the invention concerns an isolated PRO1410 polypeptide, comprising the sequence of amino acid residues 1 or about 21 to about 238, inclusive of FIG. 152 (SEQ ID NO:271), or a fragment thereof sufficient to provide a binding site for an anti-PRO1410 antibody. Preferably, the PRO1410 fragment retains a qualitative biological activity of a native PRO1410 polypeptide.

In a still further aspect, the invention provides a polypeptide produced by (i) hybridizing a test DNA molecule under stringent conditions with (a) a DNA molecule encoding a PRO1410 polypeptide having the sequence of amino acid residues from about 1 or about 21 to about 238, inclusive of FIG. 152 (SEQ ID NO:271), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1410 polypeptide. In a particular embodiment, the agonist or antagonist is an anti-PRO1410 antibody.

In a further embodiment, the invention concerns a method of identifying agonists or antagonists of a native PRO1410 polypeptide by contacting the native PRO1410 polypeptide with a candidate molecule and monitoring a biological activity mediated by said polypeptide.

In a still further embodiment, the invention concerns a composition comprising a PRO1410 polypeptide, or an agonist or antagonist as hereinabove defined, in combination with a pharmaceutically acceptable carrier.

77. PRO1568

A cDNA clone (DNA68880-1676) has been identified that encodes a novel polypeptide having sequence identity with tetraspanins and designated in the present application as "PRO1568."

In one embodiment, the invention provides an isolated nucleic acid molecule comprising DNA encoding a PRO1568 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1568 polypeptide having the sequence of amino acid residues from 1 or about 34 to about 305, inclusive of FIG. 154 (SEQ ID NO:273), or (b) the complement of the DNA molecule of (a).

In another aspect, the invention concerns an isolated nucleic acid molecule encoding a PRO1568 polypeptide comprising DNA hybridizing to the complement of the nucleic acid between about residues 307 and about 1122, inclusive, of FIG. 153 (SEQ ID NO:272). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203319 (DNA68880-1676), or (b) the complement of the DNA molecule of (a). In a preferred embodiment, the nucleic acid comprises a DNA encoding the same mature polypeptide encoded by the human protein cDNA in ATCC Deposit No. 203319 (DNA68880-1676).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 34 to about 305, inclusive of FIG. 154 (SEQ ID NO:273), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1568 polypeptide having the sequence of amino acid residues from about 34 to about 305, inclusive of FIG. 154 (SEQ ID NO:273), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1568 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 33 in the sequence of FIG. 154 (SEQ ID NO:273). The transmembrane domains have been tentatively identified as extending from about amino acids 12–35, 57–86, 94–114 and 226–248 in the PRO1568 amino acid sequence (FIG. 154, SEQ ID NO:273).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 34 to about 305, inclusive of FIG. 154 (SEQ ID NO:273), or (b) the complement of the DNA of (a).

Another embodiment is directed to fragments of a PRO1568 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1568 polypeptide encoded by any of the isolated nucleic acid sequences hereinabove defined.

In a specific aspect, the invention provides isolated native sequence PRO1568 polypeptide, which in one embodiment, includes an amino acid sequence comprising residues 34 through 305 of FIG. 154 (SEQ ID NO:273).

In another aspect, the invention concerns an isolated PRO1568 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 34 to about 305, inclusive of FIG. 154 (SEQ ID NO:273).

In a further aspect, the invention concerns an isolated PRO1568 polypeptide, comprising an amino acid sequence scoring at least about 80% positives, preferably at least about 85% positives, more preferably at least about 90% positives, most preferably at least about 95% positives when compared with the amino acid sequence of residues 34 through 305 of FIG. 154 (SEQ ID NO:273).

In yet another aspect, the invention concerns an isolated PRO1568 polypeptide, comprising the sequence of amino acid residues 34 to about 305, inclusive of FIG. 154 (SEQ ID NO:273), or a fragment thereof sufficient to provide a binding site for an anti-PRO1568 antibody. Preferably, the PRO1568 fragment retains a qualitative biological activity of a native PRO1568 polypeptide.

In a still further aspect, the invention provides a polypeptide produced by (i) hybridizing a test DNA molecule under stringent conditions with (a) a DNA molecule encoding a PRO1568 polypeptide having the sequence of amino acid residues from about 34 to about 305, inclusive of FIG. 154 (SEQ ID NO:273), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1568 polypeptide. In a particular embodiment, the agonist or antagonist is an anti-PRO1568 antibody.

In a further embodiment, the invention concerns a method of identifying agonists or antagonists of a native PRO1568 polypeptide, by contacting the native PRO1568 polypeptide with a candidate molecule and monitoring a biological activity mediated by said polypeptide.

In a still further embodiment, the invention concerns a composition comprising a PRO1568 polypeptide, or an agonist or antagonist as hereinabove defined, in combination with a pharmaceutically acceptable carrier.

78. PRO1570

A cDNA clone (DNA68885-1678) has been identified that encodes a novel polypeptide having sequence identity with SP60 and designated in the present application as "PRO1570." In particular, for the first time, Applicants have identified an additional 199 amino acids on the amino terminal end of the protein previously identified as SP60.

In one embodiment, the invention provides an isolated nucleic acid molecule comprising DNA encoding a PRO1570 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1570 polypeptide having the sequence of amino acid residues from about 1 to about 432, inclusive of FIG. 156 (SEQ ID NO:275), or (b) the complement of the DNA molecule of (a).

In another aspect, the invention concerns an isolated nucleic acid molecule encoding a PRO1570 polypeptide comprising DNA hybridizing to the complement of the nucleic acid between about residues 210 and about 1505, inclusive, of FIG. 155 (SEQ ID NO:274). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203311 (DNA68885-1678), or (b) the complement of the DNA molecule of (a). In a preferred embodiment, the nucleic acid comprises a DNA encoding the same mature polypeptide encoded by the human protein cDNA in ATCC Deposit No. 203311 (DNA68885-1678).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 432, inclusive of FIG. 156 (SEQ ID NO:275), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1570 polypeptide having the sequence of amino acid residues from about 1 to about 432, inclusive of FIG. 156 (SEQ ID NO:275), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule. In a preferred embodiment, the probes provided herein are from the amino terminal end of the peptide identified in FIG. 1, defined as amino acids 1–199 of SEQ ID NO:275.

In a specific aspect, the invention provides an isolated nucleic acid molecule comprising DNA encoding a PRO1570 polypeptide, in a form which is secreted and is soluble, i.e. transmembrane domain deleted, truncated or inactivated variants.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 432, inclusive of FIG. 156 (SEQ ID NO:275), or (b) the complement of the DNA of (a).

Another embodiment is directed to fragments of a PRO1570 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length. Preferably, the probes are from the amino terminal end as provided herein.

In another embodiment, the invention provides isolated PRO1570 polypeptide encoded by any of the isolated nucleic acid sequences hereinabove defined.

In a specific aspect, the invention provides isolated native sequence PRO1570 polypeptide, which in one embodiment, includes an amino acid sequence comprising residues 1 through 432 of FIG. 156 (SEQ ID NO:275).

In another aspect, the invention concerns an isolated PRO1570 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 432, inclusive of FIG. 156 (SEQ ID NO:275).

In a further aspect, the invention concerns an isolated PRO1570 polypeptide, comprising an amino acid sequence scoring at least about 80% positives, preferably at least about 85% positives, more preferably at least about 90% positives, most preferably at least about 95% positives when compared with the amino acid sequence of residues 1 through 432 of FIG. 156 (SEQ ID NO:275).

In yet another aspect, the invention concerns an isolated PRO1570 polypeptide, comprising the sequence of amino acid residues 1 to about 432, inclusive of FIG. 156 (SEQ ID NO:275), or a fragment thereof sufficient to provide a binding site for an anti-PRO1570 antibody. Preferably, the PRO1570 fragment retains a qualitative biological activity of a native PRO1570 polypeptide.

In a still further aspect, the invention provides a polypeptide produced by (i) hybridizing a test DNA molecule under stringent conditions with (a) a DNA molecule encoding a PRO1570 polypeptide having the sequence of amino acid residues from about 1 to about 432, inclusive of FIG. 156 (SEQ ID NO:275), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1570 polypeptide. In a particular embodiment, the agonist or antagonist is an anti-PRO1570 antibody.

In a further embodiment, the invention concerns a method of identifying agonists or antagonists of a native PRO1570 polypeptide, by contacting the native PRO1570 polypeptide with a candidate molecule and monitoring a biological activity mediated by said polypeptide.

In a still further embodiment, the invention concerns a composition comprising a PRO1570 polypeptide, or an agonist or antagonist as hereinabove defined, in combination with a pharmaceutically acceptable carrier.

79. PRO1317

A cDNA clone (DNA71166-1685) has been identified that encodes a novel polypeptide having homology to semaphorin B and designated in the present application as "PRO1317".

In one embodiment, the invention provides an isolated nucleic acid molecule comprising DNA encoding a PRO1317 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1317 polypeptide having the sequence of amino acid residues from 1 or about 31 to about 761, inclusive of FIG. 158 (SEQ ID NO:277), or (b) the complement of the DNA molecule of (a).

In another aspect, the invention concerns an isolated nucleic acid molecule encoding a PRO1317 polypeptide comprising DNA hybridizing to the complement of the nucleic acid between about residues 195 and about 2387, inclusive, of FIG. 157 (SEQ ID NO:276). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203355 (DNA71166-1685), or (b) the complement of the DNA molecule of (a). In a preferred embodiment, the nucleic acid comprises a DNA encoding the same mature polypeptide encoded by the human protein cDNA in ATCC Deposit No. 203355 (DNA71166-1685).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 31 to about 761, inclusive of FIG. 158 (SEQ ID NO:277), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1317 polypeptide having the sequence of amino acid residues from about 31 to about 761, inclusive of FIG. 158 (SEQ ID NO:277), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1317 polypeptide, with or without the N-terminal signal sequence and/or the initiating methionine, and its soluble variants (i.e. transmembrane domains deleted or inactivated), or is complementary to such encoding nucleic acid molecule. The signal peptide has been tentatively identified as extending from amino acid position 1 through about amino acid position 30 in the sequence of FIG. 158 (SEQ ID NO:277). Transmembrane domains have been tentatively identified as extending from about amino acid positions 13–31, 136–156, 222–247, 474–490, and 685–704 in the PRO1317 amino acid sequence (FIG. 158, SEQ ID NO:277).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 31 to about 761, inclusive of FIG. 158 (SEQ ID NO:277), or (b) the complement of the DNA of (a).

Another embodiment is directed to fragments of a PRO1317 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1317 polypeptide encoded by any of the isolated nucleic acid sequences hereinabove defined.

In a specific aspect, the invention provides isolated native sequence PRO1317 polypeptide, which in one embodiment, includes an amino acid sequence comprising residues 31 to 761 of FIG. 158 (SEQ ID NO:277).

In another aspect, the invention concerns an isolated PRO1317 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 31 to about 761, inclusive of FIG. 158 (SEQ ID NO:277).

In a further aspect, the invention concerns an isolated PRO1317 polypeptide, comprising an amino acid sequence scoring at least about 80% positives, preferably at least about 85% positives, more preferably at least about 90% positives, most preferably at least about 95% positives when compared with the amino acid sequence of residues 31 to 761 of FIG. 158 (SEQ ID NO:277).

In yet another aspect, the invention concerns an isolated PRO1317 polypeptide, comprising the sequence of amino acid residues 31 to about 761, inclusive of FIG. 158 (SEQ ID NO:277), or a fragment thereof sufficient to provide a binding site for an anti-PRO1317 antibody. Preferably, the PRO1317 fragment retains a qualitative biological activity of a native PRO1317 polypeptide.

In a still further aspect, the invention provides a polypeptide produced by (i) hybridizing a test DNA molecule under stringent conditions with (a) a DNA molecule encoding a PRO1317 polypeptide having the sequence of amino acid residues from about 31 to about 761, inclusive of FIG. 158 (SEQ ID NO:277), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1317 polypeptide. In a particular embodiment, the agonist or antagonist is an anti-PRO1317 antibody.

In a further embodiment, the invention concerns a method of identifying agonists or antagonists of a native PRO1317 polypeptide, by contacting the native PRO1317 polypeptide with a candidate molecule and monitoring a biological activity mediated by said polypeptide.

In a still further embodiment, the invention concerns a composition comprising a PRO11317 polypeptide, or an agonist or antagonist as hereinabove defined, in combination with a pharmaceutically acceptable carrier.

80. PRO1780

A cDNA clone (DNA71169-1709) has been identified that encodes a novel polypeptide having homology to glucuronosyltransferase and designated in the present application as "PRO1780".

In one embodiment, the invention provides an isolated nucleic acid molecule comprising DNA encoding a PRO1780 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1780 polypeptide having the sequence of amino acid residues from 1 or about 20 to about 523, inclusive of FIG. 160 (SEQ ID NO:282), or (b) the complement of the DNA molecule of (a).

In another aspect, the invention concerns an isolated nucleic acid molecule encoding a PRO1780 polypeptide comprising DNA hybridizing to the complement of the nucleic acid between about residues 125 and about 1636, inclusive, of FIG. 159 (SEQ ID NO:281). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203467 (DNA71169-1709), or (b) the complement of the DNA molecule of (a). In a preferred embodiment, the nucleic acid comprises a DNA encoding the same mature polypeptide encoded by the human protein cDNA in ATCC Deposit No. 203467 (DNA71169-1709).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 523, inclusive of FIG. 160 (SEQ ID NO:282), or the complement of the DNA of (a).

In a further aspect, the invention concerns an isolated nucleic acid molecule having at least about 50 nucleotides, and preferably at least about 100 and produced by hybridizing a test DNA molecule under stringent conditions with (a) a DNA molecule encoding a PRO1780 polypeptide having the sequence of amino acid residues from about 20 to about 523, inclusive of FIG. 160 (SEQ ID NO:282), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1780 polypeptide, with or without the N-terminal signal sequence and/or the initiating methionine, and its soluble variants (i.e. transmembrane domain deleted or inactivated), or is complementary to such encoding nucleic acid molecule. The signal peptide has been tentatively identified as extending from amino acid position 1 through about amino acid position 19 in the sequence of FIG. 160 (SEQ ID NO:282). The transmembrane domain has been tentatively identified as extending from about amino acid position 483 to about amino acid position 504 in the PRO1780 amino acid sequence (FIG. 160, SEQ ID NO:282).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 523, inclusive of FIG. 160 (SEQ ID NO:282), or (b) the complement of the DNA of (a).

Another embodiment is directed to fragments of a PRO1780 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1780 polypeptide encoded by any of the isolated nucleic acid sequences hereinabove defined.

In a specific aspect, the invention provides isolated native sequence PRO1780 polypeptide, which in one embodiment, includes an amino acid sequence comprising residues 20 to 523 of FIG. 160 (SEQ ID NO:282).

In another aspect, the invention concerns an isolated PRO1780 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 523, inclusive of FIG. 160 (SEQ ID NO:282).

In a further aspect, the invention concerns an isolated PRO1780 polypeptide, comprising an amino acid sequence scoring at least about 80% positives, preferably at least about 85% positives, more preferably at least about 90% positives, most preferably at least about 95% positives when compared with the amino acid sequence of residues 20 to 523 of FIG. 160 (SEQ ID NO:282).

In yet another aspect, the invention concerns an isolated PRO1780 polypeptide, comprising the sequence of amino acid residues 20 to about 523, inclusive of FIG. 160 (SEQ ID NO:282), or a fragment thereof sufficient to provide a binding site for an anti-PRO1780 antibody. Preferably, the PRO1780 fragment retains a qualitative biological activity of a native PRO1780 polypeptide.

In a still further aspect, the invention provides a polypeptide produced by (i) hybridizing a test DNA molecule under stringent conditions with (a) a DNA molecule encoding a PRO1780 polypeptide having the sequence of amino acid residues from about 20 to about 523, inclusive of FIG. 160 (SEQ ID NO:282), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1780 polypeptide. In a particular embodiment, the agonist or antagonist is an anti-PRO1780 antibody.

In a further embodiment, the invention concerns a method of identifying agonists or antagonists of a native PRO1780 polypeptide, by contacting the native PRO1780 polypeptide with a candidate molecule and monitoring a biological activity mediated by said polypeptide.

In a still further embodiment, the invention concerns a composition comprising a PRO1780 polypeptide, or an agonist or antagonist as hereinabove defined, in combination with a pharmaceutically acceptable carrier.

81. PRO1486

A cDNA clone (DNA71180-1655) has been identified that encodes a novel polypeptide having sequence identity with cerebellin, particularly precerebellin, and designated in the present application as "PRO1486."

In one embodiment, the invention provides an isolated nucleic acid molecule comprising DNA encoding a PRO1486 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1486 polypeptide having the sequence of amino acid residues from 1 or about 33 to about 205, inclusive of FIG. 162 (SEQ ID NO:287), or (b) the complement of the DNA molecule of (a).

In another aspect, the invention concerns an isolated nucleic acid molecule encoding a PRO1486 polypeptide comprising DNA hybridizing to the complement of the nucleic acid between about residues 568 and about 1086, inclusive, of FIG. 161 (SEQ ID NO:286). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203403 (DNA71180-1655), or (b) the complement of the DNA molecule of (a). In a preferred embodiment, the nucleic acid comprises a DNA encoding the same mature polypeptide encoded by the human protein cDNA in ATCC Deposit No. 203403 (DNA71180-1655).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 33 to about 205, inclusive of FIG. 162 (SEQ ID NO:287), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1486 polypeptide having the sequence of amino acid residues from about 33 to about 205, inclusive of FIG. 162 (SEQ ID NO:287), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 33 to about 205, inclusive of FIG. 162 (SEQ ID NO:287), or (b) the complement of the DNA of (a).

Another embodiment is directed to fragments of a PRO1486 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1486 polypeptide encoded by any of the isolated nucleic acid sequences hereinabove defined.

In a specific aspect, the invention provides isolated native sequence PRO1486 polypeptide, which in one embodiment, includes an amino acid sequence comprising residues 33 through 205 of FIG. 162 (SEQ ID NO:287).

In another aspect, the invention concerns an isolated PRO1486 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 33 to about 205, inclusive of FIG. 162 (SEQ ID NO:287).

In a further aspect, the invention concerns an isolated PRO1486 polypeptide, comprising an amino acid sequence scoring at least about 80% positives, preferably at least about 85% positives, more preferably at least about 90% positives, most preferably at least about 95% positives when compared with the amino acid sequence of residues 33 through 205 of FIG. 162 (SEQ ID NO:287).

In yet another aspect, the invention concerns an isolated PRO1486 polypeptide, comprising the sequence of amino acid residues 33 to about 205, inclusive of FIG. 162 (SEQ ID NO:287), or a fragment thereof sufficient to provide a binding site for an anti-PRO1486 antibody. Preferably, the PRO1486 fragment retains a qualitative biological activity of a native PRO1486 polypeptide.

In a still further aspect, the invention provides a polypeptide produced by (i) hybridizing a test DNA molecule under stringent conditions with (a) a DNA molecule encoding a PRO1486 polypeptide having the sequence of amino acid residues from about 33 to about 205, inclusive of FIG. 162 (SEQ ID NO:287), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1486 polypeptide. In a particular embodiment, the agonist or antagonist is an anti-PRO1486 antibody.

In a further embodiment, the invention concerns a method of identifying agonists or antagonists of a native PRO1486 polypeptide, by contacting the native PRO1486 polypeptide with a candidate molecule and monitoring a biological activity mediated by said polypeptide.

In a still further embodiment, the invention concerns a composition comprising a PRO1486 polypeptide, or an agonist or antagonist as hereinabove defined, in combination with a pharmaceutically acceptable carrier.

82. PRO1433

A cDNA clone (DNA71184-1634) has been identified that encodes a novel transmembrane polypeptide, designated in the present application as "PRO1433".

In one embodiment, the invention provides an isolated nucleic acid molecule comprising DNA encoding a PRO1433 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1433 polypeptide having the sequence of amino acid residues from about 1 to about 388, inclusive of FIG. 164 (SEQ ID NO:292), or (b) the complement of the DNA molecule of (a).

In another aspect, the invention concerns an isolated nucleic acid molecule encoding a PRO1433 polypeptide comprising DNA hybridizing to the complement of the nucleic acid between about nucleotides 185 and about 1348, inclusive, of FIG. 163 (SEQ ID NO:291). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203266 (DNA71184-1634) or (b) the complement of the nucleic acid molecule of (a). In a preferred embodiment, the nucleic acid comprises a DNA encoding the same mature polypeptide encoded by the human protein cDNA in ATCC Deposit No. 203266 (DNA71184-1634).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 388, inclusive of FIG. 164 (SEQ ID NO:292), or (b) the complement of the DNA of (a).

In a further aspect, the invention concerns an isolated nucleic acid molecule having at least 250 nucleotides and produced by hybridizing a test DNA molecule under stringent conditions with (a) a DNA molecule encoding a PRO1433 polypeptide having the sequence of amino acid residues from 1 to about 388, inclusive of FIG. 164 (SEQ ID NO:292), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1433 polypeptide, with or without the initiating methionine, and its soluble, i.e., transmembrane domain deleted or inactivated variants, or is complementary to such encoding nucleic acid molecule. The transmembrane domain has been tentatively identified as extending from about amino acid position 76 to about amino acid position 97 in the PRO1433 amino acid sequence (FIG. 164, SEQ ID NO:292).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 388, inclusive of FIG. 164 (SEQ ID NO:292), or (b) the complement of the DNA of (a).

Another embodiment is directed to fragments of a PRO1433 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 163 (SEQ ID NO:291).

In another embodiment, the invention provides isolated PRO1433 polypeptide encoded by any of the isolated nucleic acid sequences hereinabove identified.

In a specific aspect, the invention provides isolated native sequence PRO1433 polypeptide, which in certain embodiments, includes an amino acid sequence comprising residues 1 to about 388 of FIG. 164 (SEQ ID NO:292).

In another aspect, the invention concerns an isolated PRO1433 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 388, inclusive of FIG. 164 (SEQ ID NO:292).

In a further aspect, the invention concerns an isolated PRO1433 polypeptide, comprising an amino acid sequence scoring at least about 80% positives, preferably at least about 85% positives, more preferably at least about 90% positives, most preferably at least about 95% positives when compared with the amino acid sequence of residues 1 to about 388, inclusive of FIG. 164 (SEQ ID NO:292).

In yet another aspect, the invention concerns an isolated PRO1433 polypeptide, comprising the sequence of amino acid residues 1 to about 388, inclusive of FIG. 164 (SEQ ID NO:292), or a fragment thereof sufficient to provide a binding site for an anti-PRO1433 antibody. Preferably, the PRO1433 fragment retains a qualitative biological activity of a native PRO1433 polypeptide.

In a still further aspect, the invention provides a polypeptide produced by (i) hybridizing a test DNA molecule under stringent conditions with (a) a DNA molecule encoding a PRO1433 polypeptide having the sequence of amino acid residues from about 1 to about 388, inclusive of FIG. 164 (SEQ ID NO:292), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1433 polypeptide. In a particular embodiment, the agonist or antagonist is an anti-PRO1433 antibody.

In a further embodiment, the invention concerns a method of identifying agonists or antagonists of a native PRO1433 polypeptide by contacting the native PRO1433 polypeptide with a candidate molecule and monitoring a biological activity mediated by said polypeptide.

In a still further embodiment, the invention concerns a composition comprising a PRO1433 polypeptide, or an agonist or antagonist as hereinabove defined, in combination with a pharmaceutically acceptable carrier.

83. PRO1490

A cDNA clone (DNA71213-1659) has been identified, having homology to nucleic acid encoding a 1-acyl-sn-glycerol-3-phosphate acyltransferase protein that encodes a novel polypeptide, designated in the present application as "PRO1490".

In one embodiment, the invention provides an isolated nucleic acid molecule comprising DNA encoding a PRO1490 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1490 polypeptide having the sequence of amino acid residues from about 1 or about 26 to about 368, inclusive of FIG. 166 (SEQ ID NO:297), or (b) the complement of the DNA molecule of (a).

In another aspect, the invention concerns an isolated nucleic acid molecule encoding a PRO1490 polypeptide comprising DNA hybridizing to the complement of the nucleic acid between about nucleotides 272 or about 347 and about 1375, inclusive, of FIG. 165 (SEQ ID NO:296). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203401 (DNA71213-1659) or (b) the complement of the nucleic acid molecule of (a). In a preferred embodiment, the nucleic acid comprises a DNA encoding the same mature polypeptide encoded by the human protein cDNA in ATCC Deposit No. 203401 (DNA71213-1659).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 368, inclusive of FIG. 166 (SEQ ID NO:297), or (b) the complement of the DNA of (a).

In a further aspect, the invention concerns an isolated nucleic acid molecule having at least 285 nucleotides and produced by hybridizing a test DNA molecule under stringent conditions with (a) a DNA molecule encoding a PRO1490 polypeptide having the sequence of amino acid residues from 1 or about 26 to about 368, inclusive of FIG. 166 (SEQ ID NO:297), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1490 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 25 in the sequence of FIG. 166 (SEQ ID NO:297). The transmembrane domains have been tentatively identified as extending from about amino acid position 307 to about amino acid position 323 and from about amino acid position 335 to about amino acid position 352 in the PRO1490 amino acid sequence (FIG. 166, SEQ ID NO:297).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 368, inclusive of FIG. 166 (SEQ ID NO:297), or (b) the complement of the DNA of (a).

Another embodiment is directed to fragments of a PRO1490 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 165 (SEQ ID NO:296).

In another embodiment, the invention provides isolated PRO1490 polypeptide encoded by any of the isolated nucleic acid sequences hereinabove identified.

In a specific aspect, the invention provides isolated native sequence PRO1490 polypeptide, which in certain embodiments, includes an amino acid sequence comprising residues 1 or about 26 to about 368 of FIG. 166 (SEQ ID NO:297).

In another aspect, the invention concerns an isolated PRO1490 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 368, inclusive of FIG. 166 (SEQ ID NO:297).

In a further aspect, the invention concerns an isolated PRO1490 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 368, inclusive of FIG. 166 (SEQ ID NO:297).

In yet another aspect, the invention concerns an isolated PRO1490 polypeptide, comprising the sequence of amino acid residues 1 or about 26 to about 368, inclusive of FIG. 166 (SEQ ID NO:297), or a fragment thereof sufficient to provide a binding site for an anti-PRO1490 antibody. Preferably, the PRO1490 fragment retains a qualitative biological activity of a native PRO1490 polypeptide.

In a still further aspect, the invention provides a polypeptide produced by (i) hybridizing a test DNA molecule under stringent conditions with (a) a DNA molecule encoding a PRO1490 polypeptide having the sequence of amino acid residues from about 1 or about 26 to about 368, inclusive of FIG. 166 (SEQ ID NO:297), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1490 polypeptide. In a particular embodiment, the agonist or antagonist is an anti-PRO1490 antibody.

In a further embodiment, the invention concerns a method of identifying agonists or antagonists of a native PRO1490 polypeptide by contacting the native PRO1490 polypeptide with a candidate molecule and monitoring a biological activity mediated by said polypeptide.

In a still further embodiment, the invention concerns a composition comprising a PRO1490 polypeptide, or an agonist or antagonist as hereinabove defined, in combination with a pharmaceutically acceptable carrier.

84. PRO1482

A cDNA clone (DNA71234-1651) has been identified that encodes a novel secreted polypeptide, designated in the present application as "PRO1482".

In one embodiment, the invention provides an isolated nucleic acid molecule comprising DNA encoding a PRO1482 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1482 polypeptide having the sequence of amino acid residues from about 1 or about 29 to about 143, inclusive of FIG. 168 (SEQ ID NO:302), or (b) the complement of the DNA molecule of (a).

In another aspect, the invention concerns an isolated nucleic acid molecule encoding a PRO1482 polypeptide comprising DNA hybridizing to the complement of the nucleic acid between about nucleotides 33 or about 117 and about 461, inclusive, of FIG. 167 (SEQ ID NO:301). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203402 (DNA71234-1651) or (b) the complement of the nucleic acid molecule of (a). In a preferred embodiment, the nucleic acid comprises a DNA encoding the same mature polypeptide encoded by the human protein cDNA in ATCC Deposit No. 203402 (DNA71234-1651).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 29 to about 143, inclusive of FIG. 168 (SEQ ID NO:302), or (b) the complement of the DNA of (a).

In a further aspect, the invention concerns an isolated nucleic acid molecule having at least 260 nucleotides and produced by hybridizing a test DNA molecule under stringent conditions with (a) a DNA molecule encoding a PRO1482 polypeptide having the sequence of amino acid residues from 1 or about 29 to about 143, inclusive of FIG. 168 (SEQ ID NO:302), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1482 polypeptide, with or without the N-terminal signal sequence and/or the initiating methionine, or is complementary to such encoding nucleic acid molecule. The signal peptide has been tentatively identified as extending from about amino acid position 1 to about amino acid position 28 in the sequence of FIG. 168 (SEQ ID NO:302).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 29 to about 143, inclusive of FIG. 168 (SEQ ID NO:302), or (b) the complement of the DNA of (a).

Another embodiment is directed to fragments of a PRO1482 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 167 (SEQ ID NO:301).

In another embodiment, the invention provides isolated PRO1482 polypeptide encoded by any of the isolated nucleic acid sequences hereinabove identified.

In a specific aspect, the invention provides isolated native sequence PRO1482 polypeptide, which in certain embodiments, includes an amino acid sequence comprising residues 1 or about 29 to about 143 of FIG. 168 (SEQ ID NO:302).

In another aspect, the invention concerns an isolated PRO1482 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 29 to about 143, inclusive of FIG. 168 (SEQ ID NO:302).

In a further aspect, the invention concerns an isolated PRO1482 polypeptide, comprising an amino acid sequence scoring at least about 80% positives, preferably at least about 85% positives, more preferably at least about 90% positives, most preferably at least about 95% positives when compared with the amino acid sequence of residues 1 or about 29 to about 143, inclusive of FIG. 168 (SEQ ID NO:302).

In yet another aspect, the invention concerns an isolated PRO1482 polypeptide, comprising the sequence of amino acid residues 1 or about 29 to about 143, inclusive of FIG. 168 (SEQ ID NO:302), or a fragment thereof sufficient to provide a binding site for an anti-PRO1482 antibody. Preferably, the PRO1482 fragment retains a qualitative biological activity of a native PRO1482 polypeptide.

In a still further aspect, the invention provides a polypeptide produced by (i) hybridizing a test DNA molecule under stringent conditions with (a) a DNA molecule encoding a PRO1482 polypeptide having the sequence of amino acid residues from about 1 or about 29 to about 143, inclusive of FIG. 168 (SEQ ID NO:302), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1482 polypeptide. In a particular embodiment, the agonist or antagonist is an anti-PRO1482 antibody.

In a further embodiment, the invention concerns a method of identifying agonists or antagonists of a native PRO1482 polypeptide by contacting the native PRO1482 polypeptide with a candidate molecule and monitoring a biological activity mediated by said polypeptide.

In a still further embodiment, the invention concerns a composition comprising a PRO1482 polypeptide, or an agonist or antagonist as hereinabove defined, in combination with a pharmaceutically acceptable carrier.

85. PRO1446

A cDNA clone (DNA71277-1636) has been identified that encodes a novel secreted polypeptide designated in the present application as "PRO1446."

In one embodiment, the invention provides an isolated nucleic acid molecule comprising DNA encoding a PRO1446 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1446 polypeptide having the sequence of amino acid residues from 1 or about 16 to about 109, inclusive of FIG. 170 (SEQ ID NO:304), or (b) the complement of the DNA molecule of (a).

In another aspect, the invention concerns an isolated nucleic acid molecule encoding a PRO1446 polypeptide comprising DNA hybridizing to the complement of the nucleic acid between about residues 197 and about 478, inclusive, of FIG. 169 (SEQ ID NO:303). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203285 (DNA71277-1636), or (b) the complement of the DNA molecule of (a). In a preferred embodiment, the nucleic acid comprises a DNA encoding the same mature polypeptide encoded by the human protein cDNA in ATCC Deposit No. 203285 (DNA71277-1636).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 16 to about 109, inclusive of FIG. 170 (SEQ ID NO:304), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1446 polypeptide having the sequence of amino acid residues from about 16 to about 109, inclusive of FIG. 170 (SEQ ID NO:304), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 16 to about 109, inclusive of FIG. 170 (SEQ ID NO:304), or (b) the complement of the DNA of (a).

Another embodiment is directed to fragments of a PRO1446 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1446 polypeptide encoded by any of the isolated nucleic acid sequences hereinabove defined.

In a specific aspect, the invention provides isolated native sequence PRO1446 polypeptide, which in one embodiment, includes an amino acid sequence comprising residues 16 through 109 of FIG. 170 (SEQ ID NO:304).

In another aspect, the invention concerns an isolated PRO1446 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 16 to about 109, inclusive of FIG. 170 (SEQ ID NO:304).

In a further aspect, the invention concerns an isolated PRO1446 polypeptide, comprising an amino acid sequence scoring at least about 80% positives, preferably at least about 85% positives, more preferably at least about 90% positives, most preferably at least about 95% positives when compared with the amino acid sequence of residues 16 through 109 of FIG. 170 (SEQ ID NO:304).

In yet another aspect, the invention concerns an isolated PRO1446 polypeptide, comprising the sequence of amino acid residues 16 to about 109, inclusive of FIG. 170 (SEQ ID NO:304), or a fragment thereof sufficient to provide a binding site for an anti-PRO1446 antibody. Preferably, the PRO1446 fragment retains a qualitative biological activity of a native PRO1446 polypeptide.

In a still further aspect, the invention provides a polypeptide produced by (i) hybridizing a test DNA molecule under stringent conditions with (a) a DNA molecule encoding a PRO1446 polypeptide having the sequence of amino acid residues from about 16 to about 109, inclusive of FIG. 170 (SEQ ID NO:304), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1446 polypeptide. In a particular embodiment, the agonist or antagonist is an anti-PRO1446 antibody.

In a further embodiment, the invention concerns a method of identifying agonists or antagonists of a native PRO1446 polypeptide, by contacting the native PRO1446 polypeptide with a candidate molecule and monitoring a biological activity mediated by said polypeptide.

In a still further embodiment, the invention concerns a composition comprising a PRO1446 polypeptide, or an agonist or antagonist as hereinabove defined, in combination with a pharmaceutically acceptable carrier.

86. PRO1558

A cDNA clone (DNA71282-1668) has been identified, having homology to nucleic acid encoding methyltransferase enzymes that encodes a novel polypeptide, designated in the present application as "PRO1558".

In one embodiment, the invention provides an isolated nucleic acid molecule comprising DNA encoding a PRO1558 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1558 polypeptide having the sequence of amino acid residues from about 1 or about 26 to about 262, inclusive of FIG. 172 (SEQ ID NO:306), or (b) the complement of the DNA molecule of (a).

In another aspect, the invention concerns an isolated nucleic acid molecule encoding a PRO1558 polypeptide comprising DNA hybridizing to the complement of the nucleic acid between about nucleotides 84 or about 159 and about 869, inclusive, of FIG. 171 (SEQ ID NO:305). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203312 (DNA71282-1668) or (b) the complement of the nucleic acid molecule of (a). In a preferred embodiment, the nucleic acid comprises a DNA encoding the same mature polypeptide encoded by the human protein cDNA in ATCC Deposit No. 203312 (DNA71282-1668).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 26 to about 262, inclusive of FIG. 172 (SEQ ID NO:306), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1558 polypeptide having the sequence of amino acid residues from 1 or about 26 to about 262, inclusive of FIG. 172 (SEQ ID NO:306), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1558 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 25 in the sequence of FIG. 172 (SEQ ID NO:306). The transmembrane domains have been tentatively identified as extending from about amino acid position 8 to about amino acid position 30 and from about amino acid position 109 to about amino acid position 130 in the PRO1558 amino acid sequence (FIG. 172, SEQ ID NO:306).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 26 to about 262, inclusive of FIG. 172 (SEQ ID NO:306), or (b) the complement of the DNA of (a).

Another embodiment is directed to fragments of a PRO1558 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 171 (SEQ ID NO:305).

In another embodiment, the invention provides isolated PRO1558 polypeptide encoded by any of the isolated nucleic acid sequences hereinabove identified.

In a specific aspect, the invention provides isolated native sequence PRO1558 polypeptide, which in certain embodiments, includes an amino acid sequence comprising residues 1 or about 26 to about 262 of FIG. 172 (SEQ ID NO:306

In another aspect, the invention concerns an isolated PRO1558 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 26 to about 262, inclusive of FIG. 17(SEQ ID NO:306)

In a further aspect, the invention concerns an isolated PRO1558 polypeptide, comprising an amino acid sequence scoring at least about 80% positives, preferably at least about 85% positives, more preferably at least about 90% positives, most preferably at least about 95% positives when compared with the amino acid sequence of residues 1 or about 26 to about 262, inclusive of FIG. 17(SEQ ID NO:306)

In yet another aspect, the invention concerns an isolated PRO1558 polypeptide, comprising the sequence of amino acid residues 1 or about 26 to about 262, inclusive of FIG. 172 (SEQ ID NO:306), or a fragment thereof sufficient to provide a binding site for an anti-PRO1558 antibody. Preferably, the PRO1558 fragment retains a qualitative biological activity of a native PRO1558 polypeptide.

In a still further aspect, the invention provides a polypeptide produced by (i) hybridizing a test DNA molecule under stringent conditions with (a) a DNA molecule encoding a PRO1558 polypeptide having the sequence of amino acid residues from about 1 or about 26 to about 262, inclusive of FIG. 172 (SEQ ID NO:306), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1558 polypeptide. In a particular embodiment, the agonist or antagonist is an anti-PRO1558 antibody.

In a further embodiment, the invention concerns a method of identifying agonists or antagonists of a native PRO1558 polypeptide by contacting the native PRO1558 polypeptide with a candidate molecule and monitoring a biological activity mediated by said polypeptide.

In a still further embodiment, the invention concerns a composition comprising a PRO1558 polypeptide, or an agonist or antagonist as hereinabove defined, in combination with a pharmaceutically acceptable carrier.

87. PRO1604

A cDNA clone (DNA71286-1687) has been identified that encodes a novel polypeptide having homology to hepatoma-derived growth factor (HDGF) designated in the present application as "PRO1604".

In one embodiment, the invention provides an isolated nucleic acid molecule comprising DNA encoding a PRO1604 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1604 polypeptide having the sequence of amino acid residues from 1 or about 14 to about 671, inclusive of FIG. 174 (SEQ ID NO:308), or (b) the complement of the DNA molecule of (a).

In another aspect, the invention concerns an isolated nucleic acid molecule encoding a PRO1604 polypeptide comprising DNA hybridizing to the complement of the nucleic acid between about residues 104 and about 2077, inclusive, of FIG. 173 (SEQ ID NO:307). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203357 (DNA71286-1687), or (b) the complement of the DNA molecule of (a). In a preferred embodiment, the nucleic acid comprises a DNA encoding the same mature polypeptide encoded by the human protein cDNA in ATCC Deposit No. 203357 (DNA71286-1687).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 14 to about 671, inclusive of FIG. 174 (SEQ ID NO:308), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1604 polypeptide having the sequence of amino acid residues from about 14 to about 671, inclusive of FIG. 174 (SEQ ID NO:308), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1604 polypeptide, with or without the N-terminal signal sequence, or is complementary to such encoding nucleic acid molecule. The signal peptide has been tentatively identified as extending from amino acid position 1 through about amino acid position 13 in the sequence of FIG. 174 (SEQ ID NO:308).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 14 to about 671, inclusive of FIG. 174 (SEQ ID NO:308), or (b) the complement of the DNA of (a).

Another embodiment is directed to fragments of a PRO1604 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1604 polypeptide encoded by any of the isolated nucleic acid sequences hereinabove defined.

In a specific aspect, the invention provides isolated native sequence PRO1604 polypeptide, which in one embodiment, includes an amino acid sequence comprising residues 14 to 671 of FIG. 174 (SEQ ID NO:308).

In another aspect, the invention concerns an isolated PRO1604 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 14 to about 671, inclusive of FIG. 174 (SEQ ID NO:308).

In a further aspect, the invention concerns an isolated PRO1604 polypeptide, comprising an amino acid sequence scoring at least about 80% positives, preferably at least about 85% positives, more preferably at least about 90% positives, most preferably at least about 95% positives when compared with the amino acid sequence of residues 14 to 671 of FIG. 174 (SEQ ID NO:308).

In yet another aspect, the invention concerns an isolated PRO1604 polypeptide, comprising the sequence of amino acid residues 14 to about 671, inclusive of FIG. 174 (SEQ ID NO:308), or a fragment thereof sufficient to provide a binding site for an anti-PRO1604 antibody. Preferably, the PRO1604 fragment retains a qualitative biological activity of a native PRO1604 polypeptide.

In a still further aspect, the invention provides a polypeptide produced by (i) hybridizing a test DNA molecule under stringent conditions with (a) a DNA molecule encoding a PRO1604 polypeptide having the sequence of amino acid residues from about 14 to about 671, inclusive of FIG. 174 (SEQ ID NO:308), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1604 polypeptide. In a particular embodiment, the agonist or antagonist is an anti-PRO1604 antibody.

In a further embodiment, the invention concerns a method of identifying agonists or antagonists of a native PRO1604 polypeptide, by contacting the native PRO1604 polypeptide with a candidate molecule and monitoring a biological activity mediated by said polypeptide.

In a still further embodiment, the invention concerns a composition comprising a PRO1604polypeptide, or an agonist or antagonist as hereinabove defined, in combination with a pharmaceutically acceptable carrier.

88. PRO1491

A cDNA clone (DNA71883-1660) has been identified, having homology to nucleic acid encoding a collapsin protein, that encodes a novel polypeptide, designated in the present application as "PRO1491".

In one embodiment, the invention provides an isolated nucleic acid molecule comprising DNA encoding a PRO1491 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1491 polypeptide having the sequence of amino acid residues from about 1 or about 37 to about 777, inclusive of FIG. 176 (SEQ ID NO:310), or (b) the complement of the DNA molecule of (a).

In another aspect, the invention concerns an isolated nucleic acid molecule encoding a PRO1491 polypeptide comprising DNA hybridizing to the complement of the nucleic acid between about nucleotides 107 or about 215 and about 2437, inclusive, of FIG. 175 (SEQ ID NO:309). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203475 (DNA71883-1660) or (b) the complement of the nucleic acid molecule of (a). In a preferred embodiment, the nucleic acid comprises a DNA encoding the same mature polypeptide encoded by the human protein cDNA in ATCC Deposit No. 203475 (DNA71883-1660).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 37 to about 777, inclusive of FIG. 176 (SEQ ID NO:310), or (b) the complement of the DNA of (a).

In a further aspect, the invention concerns an isolated nucleic acid molecule having at least 1,670 nucleotides and produced by hybridizing a test DNA molecule under stringent conditions with (a) a DNA molecule encoding a PRO1491 polypeptide having the sequence of amino acid residues from 1 or about 37 to about 777, inclusive of FIG. 176 (SEQ ID NO:310), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1491 polypeptide, with or without the N-terminal signal sequence and/or the initiating methionine, or is complementary to such encoding nucleic acid molecule. The signal peptide has been tentatively identified as extending from about amino acid position 1 to about amino acid position 36 in the sequence of FIG. 176 (SEQ ID NO:310).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 37 to about 777, inclusive of FIG. 176 (SEQ ID NO:310), or (b) the complement of the DNA of (a).

Another embodiment is directed to fragments of a PRO1491 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 175 (SEQ ID NO:309).

In another embodiment, the invention provides isolated PRO1491 polypeptide encoded by any of the isolated nucleic acid sequences hereinabove identified.

In a specific aspect, the invention provides isolated native sequence PRO1491 polypeptide, which in certain embodiments, includes an amino acid sequence comprising residues 1 or about 37 to about 777 of FIG. 176 (SEQ ID NO:310).

In another aspect, the invention concerns an isolated PRO1491 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 37 to about 777, inclusive of FIG. 176 (SEQ ID NO:310).

In a further aspect, the invention concerns an isolated PRO1491 polypeptide, comprising an amino acid sequence scoring at least about 80% positives, preferably at least about 85% positives, more preferably at least about 90% positives, most preferably at least about 95% positives when compared with the amino acid sequence of residues 1 or about 37 to about 777, inclusive of FIG. 176 (SEQ ID NO:310).

In yet another aspect, the invention concerns an isolated PRO1491 polypeptide, comprising the sequence of amino acid residues 1 or about 37 to about 777, inclusive of FIG. 176 (SEQ ID NO:310), or a fragment thereof sufficient to provide a binding site for an anti-PRO1491 antibody. Preferably, the PRO1491 fragment retains a qualitative biological activity of a native PRO1491 polypeptide.

In a still further aspect, the invention provides a polypeptide produced by (i) hybridizing a test DNA molecule under stringent conditions with (a) a DNA molecule encoding a PRO1491 polypeptide having the sequence of amino acid residues from about 1 or about 37 to about 777, inclusive of FIG. 176 (SEQ ID NO:310), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1491 polypeptide. In a particular embodiment, the agonist or antagonist is an anti-PRO1491 antibody.

In a further embodiment, the invention concerns a method of identifying agonists or antagonists of a native PRO1491 polypeptide by contacting the native PRO1491 polypeptide with a candidate molecule and monitoring a biological activity mediated by said polypeptide.

In a still further embodiment, the invention concerns a composition comprising a PRO1491 polypeptide, or an agonist or antagonist as hereinabove defined, in combination with a pharmaceutically acceptable carrier.

89. PRO1431

A cDNA clone (DNA73401-1633) has been identified having a domain with homology to SH3 that encodes a novel polypeptide, which has been designated in the present application as "PRO1431".

In one embodiment, the invention provides an isolated nucleic acid molecule comprising DNA encoding a PRO1431 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1431 polypeptide having the sequence of amino acid residues from about 1 to about 370, inclusive of FIG. 178 (SEQ ID NO:315) or (b) the complement of the DNA molecule of (a).

In another aspect, the invention concerns an isolated nucleic acid molecule encoding a PRO1431 polypeptide comprising DNA hybridizing to the complement of the nucleic acid between residues 1 to about 1335 and about 1560 to about 3934, inclusive, of FIG. 177 (SEQ ID NO:314). Preferably, hybridization occurs under stringent hybridization and wash conditions.

In a further aspect, the invention concerns (a) an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203273 (DNA73401-1633) or (b) the complement of the DNA molecule of (a). In a preferred embodiment, the nucleic acid comprises a DNA encoding the same mature polypeptide encoded by the human protein cDNA in ATCC Deposit No. 203273 (DNA73401-1633).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 370, inclusive, of FIG. 178 (SEQ ID NO:315), or the complement of the DNA of (a).

In a further aspect, the invention concerns an isolated nucleic acid molecule having at least about 15 nucleotides that is produced by hybridizing a test DNA molecule under stringent conditions with (a) a DNA molecule encoding a PRO1431 polypeptide having the sequence of amino acid residues from about 1 to about 370, inclusive, of FIG. 178 (SEQ ID NO:315), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 370, inclusive, of FIG. 178 (SEQ ID NO:315), inclusive, of FIG. 178 (SEQ ID NO:315).

In another embodiment, the invention provides isolated PRO1431 polypeptide encoded by any of the isolated nucleic acid sequences hereinabove defined.

In a specific aspect, the invention provides isolated native sequence PRO1431 polypeptide, which in one embodiment, includes an amino acid sequence comprising residues 1 to 370, inclusive, of FIG. 178 (SEQ ID NO:315).

In another aspect, the invention concerns an isolated PRO1431 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 370, inclusive, of FIG. 178 (SEQ ID NO:315).

In a further aspect, the invention concerns an isolated PRO1431 polypeptide, comprising an amino acid sequence scoring at least about 80% positives, preferably at least about 85% positives, more preferably at least about 90% positives, most preferably at least about 95% positives when compared with the amino acid sequence of residues 1 to 370 of FIG. 178 (SEQ ID NO:315).

In yet another aspect, the invention concerns an isolated PRO1431 or PRO1432 polypeptide, comprising the sequence of amino acid residues 1 to about 370, inclusive, or FIG. 178 (SEQ ID NO:315), inclusive, of FIG. 178 (SEQ ID NO:315), or a fragment thereof sufficient to provide a binding site for an anti-PRO1431 antibody. Preferably, the PRO1431 fragment retains a qualitative biological activity of a native PRO1431 polypeptide.

In a still further aspect, the invention provides a polypeptide produced by (i) hybridizing a test DNA molecule under stringent conditions with (a) a DNA molecule encoding a PRO1431 polypeptide having the sequence of amino acid residues from about 1 to about 370, inclusive, of FIG. 178 (SEQ ID NO:315), inclusive, of FIG. 178 (SEQ ID NO:315), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1431 polypeptide. In a particular embodiment, the agonist or antagonist is an anti-PRO1431 antibody.

In a further embodiment, the invention concerns a method of identifying agonists or antagonists of a native PRO1431 polypeptide, by contacting the native PRO1431 polypeptide with a candidate molecule and monitoring a biological activity mediated by said polypeptide.

In a still further embodiment, the invention concerns a composition comprising a PRO1431 polypeptide, or an agonist or antagonist as hereinabove defined, in combination with a pharmaceutically acceptable carrier.

90. PRO1563

A cDNA clone (DNA73492-1671) has been identified, having homology to nucleic acid encoding ADAMTS-1 that encodes a novel polypeptide, designated in the present application as "PRO1563".

In one embodiment, the invention provides an isolated nucleic acid molecule comprising DNA encoding a PRO1563 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1563 polypeptide having the sequence of amino acid residues from about 1 or about 49 to about 837, inclusive of FIG. 180 (SEQ ID NO:317), or (b) the complement of the DNA molecule of (a).

In another aspect, the invention concerns an isolated nucleic acid molecule encoding a PRO1563 polypeptide comprising DNA hybridizing to the complement of the nucleic acid between about nucleotides 419 or about 563 and about 2929, inclusive, of FIGS. 179A–B (SEQ ID NO:316). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203324 (DNA73492-1671) or (b) the complement of the nucleic acid molecule of (a). In a preferred embodiment, the nucleic acid comprises a DNA encoding the same mature polypeptide encoded by the human protein cDNA in ATCC Deposit No. 203324 (DNA73492-1671).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 49 to about 837, inclusive of FIG. 180 (SEQ ID NO:317), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1563 polypeptide having the sequence of amino acid residues from 1 or about 49 to about 837, inclusive of FIG. 180 (SEQ ID NO:317), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1563 polypeptide, with or without the N-terminal signal sequence and/or the initiating methionine, or is complementary to such encoding nucleic acid molecule. The signal peptide has been tentatively identified as extending from about amino acid position 1 to about amino acid position 48 in the sequence of FIG. 180 (SEQ ID NO:317).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 49 to about 837, inclusive of FIG. 180 (SEQ ID NO:317), or (b) the complement of the DNA of (a).

Another embodiment is directed to fragments of a PRO1563 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIGS. 179A–B (SEQ ID NO:316).

In another embodiment, the invention provides isolated PRO1563 polypeptide encoded by any of the isolated nucleic acid sequences hereinabove identified.

In a specific aspect, the invention provides isolated native sequence PRO1563 polypeptide, which in certain embodiments, includes an amino acid sequence comprising residues 1 or about 49 to about 837 of FIG. 180 (SEQ ID NO:317).

In another aspect, the invention concerns an isolated PRO1563 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 49 to about 837, inclusive of FIG. 180 (SEQ ID NO:317).

In a further aspect, the invention concerns an isolated PRO1563 polypeptide, comprising an amino acid sequence scoring at least about 80% positives, preferably at least about 85% positives, more preferably at least about 90% positives, most preferably at least about 95% positives when compared with the amino acid sequence of residues 1 or about 49 to about 837, inclusive of FIG. 180 (SEQ ID NO:317).

In yet another aspect, the invention concerns an isolated PRO1563 polypeptide, comprising the sequence of amino acid residues 1 or about 49 to about 837, inclusive of FIG. 180 (SEQ ID NO:317), or a fragment thereof sufficient to provide a binding site for an anti-PRO1563 antibody. Preferably, the PRO1563 fragment retains a qualitative biological activity of a native PRO1563 polypeptide.

In a still further aspect, the invention provides a polypeptide produced by (i) hybridizing a test DNA molecule under stringent conditions with (a) a DNA molecule encoding a PRO1563 polypeptide having the sequence of amino acid residues from about 1 or about 49 to about 837, inclusive of FIG. 180 (SEQ ID NO:317), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1563 polypeptide. In a particular embodiment, the agonist or antagonist is an anti-PRO1563 antibody.

In a further embodiment, the invention concerns a method of identifying agonists or antagonists of a native PRO1563 polypeptide by contacting the native PRO1563 polypeptide with a candidate molecule and monitoring a biological activity mediated by said polypeptide.

In a still further embodiment, the invention concerns a composition comprising a PRO1563 polypeptide, or an agonist or antagonist as hereinabove defined, in combination with a pharmaceutically acceptable carrier.

91. PRO1565

A cDNA clone (DNA73727-1673) has been identified, having homology to nucleic acid encoding a chondromodulin protein that encodes a novel polypeptide, designated in the present application as "PRO1565".

In one embodiment, the invention provides an isolated nucleic acid molecule comprising DNA encoding a PRO1565 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1565 polypeptide having the sequence of amino acid residues from about 1 or about 41 to about 317, inclusive of FIG. 182 (SEQ ID NO:322), or (b) the complement of the DNA molecule of (a).

In another aspect, the invention concerns an isolated nucleic acid molecule encoding a PRO1565 polypeptide comprising DNA hybridizing to the complement of the nucleic acid between about nucleotides 59 or about 179 and about 1009, inclusive, of FIG. 181 (SEQ ID NO:321). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203459 (DNA73727-1673) or (b) the complement of the nucleic acid molecule of (a). In a preferred embodiment, the nucleic acid comprises a DNA encoding the same mature polypeptide encoded by the human protein cDNA in ATCC Deposit No. 203459 (DNA73727-1673).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 41 to about 317, inclusive of FIG. 182 (SEQ ID NO:322), or (b) the complement of the DNA of (a).

In a further aspect, the invention concerns an isolated nucleic acid molecule having at least 410 nucleotides and produced by hybridizing a test DNA molecule under stringent conditions with (a) a DNA molecule encoding a PRO1565 polypeptide having the sequence of amino acid residues from 1 or about 41 to about 317, inclusive of FIG. 182 (SEQ ID NO:322), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1565 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 40 in the sequence of FIG. 182 (SEQ ID NO:322). The transmembrane domain has been tentatively identified as extending from about amino acid position 25 to about amino acid position 47 in the PRO1565 amino acid sequence (FIG. 182, SEQ ID NO:322).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 41 to about 317, inclusive of FIG. 182 (SEQ ID NO:322), or (b) the complement of the DNA of (a).

Another embodiment is directed to fragments of a PRO1565 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 181 (SEQ ID NO:321).

In another embodiment, the invention provides isolated PRO1565 polypeptide encoded by any of the isolated nucleic acid sequences hereinabove identified.

In a specific aspect, the invention provides isolated native sequence PRO1565 polypeptide, which in certain embodiments, includes an amino acid sequence comprising residues 1 or about 41 to about 317 of FIG. 182 (SEQ ID NO:322).

In another aspect, the invention concerns an isolated PRO1565 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 41 to about 317, inclusive of FIG. 182 (SEQ ID NO:322).

In a further aspect, the invention concerns an isolated PRO1565 polypeptide, comprising an amino acid sequence scoring at least about 80% positives, preferably at least about 85% positives, more preferably at least about 90% positives, most preferably at least about 95% positives when compared with the amino acid sequence of residues 1 or about 41 to about 317, inclusive of FIG. 182 (SEQ ID NO:322).

In yet another aspect, the invention concerns an isolated PRO1565 polypeptide, comprising the sequence of amino acid residues 1 or about 41 to about 317, inclusive of FIG. 182 (SEQ ID NO:322), or a fragment thereof sufficient to provide a binding site for an anti-PRO1565 antibody. Preferably, the PRO1565 fragment retains a qualitative biological activity of a native PRO1565 polypeptide.

In a still further aspect, the invention provides a polypeptide produced by (i) hybridizing a test DNA molecule under stringent conditions with (a) a DNA molecule encoding a PRO1565 polypeptide having the sequence of amino acid residues from about 1 or about 41 to about 317, inclusive of FIG. 182 (SEQ ID NO:322), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1565 polypeptide. In a particular embodiment, the agonist or antagonist is an anti-PRO1565 antibody.

In a further embodiment, the invention concerns a method of identifying agonists or antagonists of a native PRO1565 polypeptide by contacting the native PRO1565 polypeptide with a candidate molecule and monitoring a biological activity mediated by said polypeptide.

In a still further embodiment, the invention concerns a composition comprising a PRO1565 polypeptide, or an agonist or antagonist as hereinabove defined, in combination with a pharmaceutically acceptable carrier.

92. PRO1571

A cDNA clone (DNA73730-1679) has been identified, having homology to nucleic acid encoding the clostridium perfringens enterotoxin receptor (CPE-R) that encodes a novel polypeptide, designated in the present application as "PRO1571".

In one embodiment, the invention provides an isolated nucleic acid molecule comprising DNA encoding a PRO1571 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1571 polypeptide having the sequence of amino acid residues from about 1 or about 22 to about 239, inclusive of FIG. 184 (SEQ ID NO:324), or (b) the complement of the DNA molecule of (a).

In another aspect, the invention concerns an isolated nucleic acid molecule encoding a PRO1571 polypeptide comprising DNA hybridizing to the complement of the nucleic acid between about nucleotides 90 or about 153 and about 806, inclusive, of FIG. 183 (SEQ ID NO:323). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203320 (DNA73730-1679) or (b) the complement of the nucleic acid molecule of (a). In a preferred embodiment, the nucleic acid comprises a DNA encoding the same mature polypeptide encoded by the human protein cDNA in ATCC Deposit No. 203320 (DNA73730-1679).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 22 to about 239, inclusive of FIG. 184 (SEQ ID NO:324), or (b) the complement of the DNA of (a).

In a further aspect, the invention concerns an isolated nucleic acid molecule having at least 910 nucleotides and produced by hybridizing a test DNA molecule under stringent conditions with (a) a DNA molecule encoding a PRO1571 polypeptide having the sequence of amino acid residues from 1 or about 22 to about 239, inclusive of FIG. 184 (SEQ ID NO:324), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1571 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 21 in the sequence of FIG. 184 (SEQ ID NO:324). The transmembrane domains have been tentatively identified as extending from about amino acid position 82 to about amino acid position 103, from about amino acid position 115 to about amino acid position 141 and from about amino acid position 160 to about amino acid position 182 in the PRO1571 amino acid sequence (FIG. 184, SEQ ID NO:324).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 22 to about 239, inclusive of FIG. 184 (SEQ ID NO:324), or (b) the complement of the DNA of (a).

Another embodiment is directed to fragments of a PRO1571 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 183 (SEQ ID NO:323).

In another embodiment, the invention provides isolated PRO1571 polypeptide encoded by any of the isolated nucleic acid sequences hereinabove identified.

In a specific aspect, the invention provides isolated native sequence PRO1571 polypeptide, which in certain embodiments, includes an amino acid sequence comprising residues 1 or about 22 to about 239 of FIG. 184 (SEQ ID NO:324).

In another aspect, the invention concerns an isolated PRO1571 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 22 to about 239, inclusive of FIG. 184 (SEQ ID NO:324).

In a further aspect, the invention concerns an isolated PRO1571 polypeptide, comprising an amino acid sequence scoring at least about 80% positives, preferably at least about 85% positives, more preferably at least about 90% positives, most preferably at least about 95% positives when compared with the amino acid sequence of residues 1 or about 22 to about 239, inclusive of FIG. 184 (SEQ ID NO:324).

In yet another aspect, the invention concerns an isolated PRO1571 polypeptide, comprising the sequence of amino acid residues 1 or about 22 to about 239, inclusive of FIG. 184 (SEQ ID NO:324), or a fragment thereof sufficient to provide a binding site for an anti-PRO1571 antibody. Preferably, the PRO1571 fragment retains a qualitative biological activity of a native PRO1571 polypeptide.

In a still further aspect, the invention provides a polypeptide produced by (i) hybridizing a test DNA molecule under stringent conditions with (a) a DNA molecule encoding a PRO1571 polypeptide having the sequence of amino acid residues from about 1 or about 22 to about 239, inclusive of FIG. 184 (SEQ ID NO:324), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1571 polypeptide. In a particular embodiment, the agonist or antagonist is an anti-PRO1571 antibody.

In a further embodiment, the invention concerns a method of identifying agonists or antagonists of a native PRO1571 polypeptide by contacting the native PRO1571 polypeptide with a candidate molecule and monitoring a biological activity mediated by said polypeptide.

In a still further embodiment, the invention concerns a composition comprising a PRO1571 polypeptide, or an agonist or antagonist as hereinabove defined, in combination with a pharmaceutically acceptable carrier.

93. PRO1572

A cDNA clone (DNA73734-1680) has been identified that encodes a novel polypeptide having sequence identity with CPE-R and designated in the present application as "PRO1572."

In one embodiment, the invention provides an isolated nucleic acid molecule comprising DNA encoding a PRO1572 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1572 polypeptide having the sequence of amino acid residues from 1 or about 24 to about 261, inclusive of FIG. 186 (SEQ ID NO:326), or (b) the complement of the DNA molecule of (a).

In another aspect, the invention concerns an isolated nucleic acid molecule encoding a PRO1572 polypeptide comprising DNA hybridizing to the complement of the nucleic acid between about residues 159 and about 872, inclusive, of FIG. 185 (SEQ ID NO:325). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203363 (DNA73734-1680), or (b) the complement of the DNA molecule of (a). In a preferred embodiment, the nucleic acid comprises a DNA encoding the same mature polypeptide encoded by the human protein cDNA in ATCC Deposit No. 203363 (DNA73734-1680).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 24 to about 261, inclusive of FIG. 186 (SEQ ID NO:326), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1572 polypeptide having the sequence of amino acid residues from about 24 to about 261, inclusive of FIG. 186 (SEQ ID NO:326), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1572 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 23 in the sequence of FIG. 186 (SEQ ID NO:326). The transmembrane domains have been tentatively identified as approximately at about 81–100, 121–141 and 173–194 in the PRO1572 amino acid sequence (FIG. 186, SEQ ID NO:326).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 24 to about 261, inclusive of FIG. 186 (SEQ ID NO:326), or (b) the complement of the DNA of (a).

Another embodiment is directed to fragments of a PRO1572 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1572 polypeptide encoded by any of the isolated nucleic acid sequences hereinabove defined.

In a specific aspect, the invention provides isolated native sequence PRO1572 polypeptide, which in one embodiment, includes an amino acid sequence comprising residues 24 through 261 of FIG. 186 (SEQ ID NO:326).

In another aspect, the invention concerns an isolated PRO1572 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 24 to about 261, inclusive of FIG. 186 (SEQ ID NO:326).

In a further aspect, the invention concerns an isolated PRO1572 polypeptide, comprising an amino acid sequence scoring at least about 80% positives, preferably at least about 85% positives, more preferably at least about 90% positives, most preferably at least about 95% positives when compared with the amino acid sequence of residues 24 through 261 of FIG. 186 (SEQ ID NO:326).

In yet another aspect, the invention concerns an isolated PRO1572polypeptide, comprising the sequence of amino acid residues 24 to about 261, inclusive of FIG. 186 (SEQ ID NO:326), or a fragment thereof sufficient to provide a binding site for an anti-PRO1572 antibody. Preferably, the PRO1572 fragment retains a qualitative biological activity of a native PRO1572 polypeptide.

In a still further aspect, the invention provides a polypeptide produced by (i) hybridizing a test DNA molecule under stringent conditions with (a) a DNA molecule encoding a PRO1572 polypeptide having the sequence of amino acid residues from about 24 to about 261, inclusive of FIG. 186 (SEQ ID NO:326), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1572 polypeptide. In a particular embodiment, the agonist or antagonist is an anti-PRO1572 antibody.

In a further embodiment, the invention concerns a method of identifying agonists or antagonists of a native PRO1572 polypeptide, by contacting the native PRO1572 polypeptide with a candidate molecule and monitoring a biological activity mediated by said polypeptide.

In a still further embodiment, the invention concerns a composition comprising a PRO1572 polypeptide, or an agonist or antagonist as hereinabove defined, in combination with a pharmaceutically acceptable carrier.

94. PRO1573

A cDNA clone (DNA73735-1681) has been identified that encodes a novel polypeptide having sequence identity with CPE-R and designated in the present application as "PRO1573".

In one embodiment, the invention provides an isolated nucleic acid molecule comprising DNA encoding a PRO1573 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1573 polypeptide having the sequence of amino acid residues from 1 or about 18 to about 225, inclusive of FIG. 188 (SEQ ID NO:328), or (b) the complement of the DNA molecule of (a).

In another aspect, the invention concerns an isolated nucleic acid molecule encoding a PRO1573 polypeptide comprising DNA hybridizing to the complement of the nucleic acid between about residues 148 and about 771, inclusive, of FIG. 187 (SEQ ID NO:327). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203356 (DNA73735-1681), or (b) the complement of the DNA molecule of (a). In a preferred embodiment, the nucleic acid comprises a DNA encoding the same mature polypeptide encoded by the human protein cDNA in ATCC Deposit No. 203356 (DNA73735-1681).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 18 to about 225, inclusive of FIG. 188 (SEQ ID NO:328), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1573 polypeptide having the sequence of amino acid residues from about 18 to about 225, inclusive of FIG. 188 (SEQ ID NO:328), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1573 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 17 in the sequence of FIG. 188 (SEQ ID NO:328). The transmembrane domains have been tentatively identified as at approximately 82–101, 118–145 and 164–188 in the PRO1573 amino acid sequence (FIG. 188, SEQ ID NO:328).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 18 to about 225, inclusive of FIG. 188 (SEQ ID NO:328), or (b) the complement of the DNA of (a).

Another embodiment is directed to fragments of a PRO1573 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1573 polypeptide encoded by any of the isolated nucleic acid sequences hereinabove defined.

In a specific aspect, the invention provides isolated native sequence PRO1573 polypeptide, which in one embodiment, includes an amino acid sequence comprising residues 18 through 225 of FIG. 188 (SEQ ID NO:328).

In another aspect, the invention concerns an isolated PRO1573 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 18 to about 225, inclusive of FIG. 188 (SEQ ID NO:328).

In a further aspect, the invention concerns an isolated PRO1573 polypeptide, comprising an amino acid sequence scoring at least about 80% positives, preferably at least about 85% positives, more preferably at least about 90% positives, most preferably at least about 95% positives when compared with the amino acid sequence of residues 18 through 225 of FIG. 188 (SEQ ID NO:328).

In yet another aspect, the invention concerns an isolated PRO1573 polypeptide, comprising the sequence of amino acid residues 18 to about 225, inclusive of FIG. 188 (SEQ ID NO:328), or a fragment thereof sufficient to provide a binding site for an anti-PRO1573 antibody. Preferably, the PRO1573 fragment retains a qualitative biological activity of a native PRO1573 polypeptide.

In a still further aspect, the invention provides a polypeptide produced by (i) hybridizing a test DNA molecule under stringent conditions with (a) a DNA molecule encoding a PRO1573 polypeptide having the sequence of amino acid residues from about 18 to about 225, inclusive of FIG. 188 (SEQ ID NO:328), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1573 polypeptide. In a particular embodiment, the agonist or antagonist is an anti-PRO1573 antibody.

In a further embodiment, the invention concerns a method of identifying agonists or antagonists of a native PRO1573 polypeptide, by contacting the native PRO1573 polypeptide with a candidate molecule and monitoring a biological activity mediated by said polypeptide.

In a still further embodiment, the invention concerns a composition comprising a PRO1573 polypeptide, or an agonist or antagonist as hereinabove defined, in combination with a pharmaceutically acceptable carrier.

95. PRO1488

A cDNA clone (DNA73736-1657) has been identified that encodes a novel polypeptide having homology to *Clostridium perfringens* enterotoxin receptor (CPE-R), designated in the present application as "PRO1488".

In one embodiment, the invention provides an isolated nucleic acid molecule comprising DNA encoding a PRO1488 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1488 polypeptide having the sequence of amino acid residues from about 1 to about 220, inclusive of FIG. 190 (SEQ ID NO:330), or (b) the complement of the DNA molecule of (a).

In another aspect, the invention concerns an isolated nucleic acid molecule encoding a PRO1488 polypeptide comprising DNA hybridizing to the complement of the nucleic acid between about residues 6 and about 665, inclusive, of FIG. 189 (SEQ ID NO:329). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203466 (DNA73736-1657), or (b) the complement of the DNA molecule of (a). In a preferred embodiment, the nucleic acid comprises a DNA encoding the same mature polypeptide encoded by the human protein cDNA in ATCC Deposit No. 203466 (DNA73736-1657).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 220, inclusive of FIG. 190 (SEQ ID NO:330), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1488 polypeptide having the sequence of amino acid residues from about 1 to about 220, inclusive of FIG. 190 (SEQ ID NO:330), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1488 polypeptide, with or without the initiating methionine, and its soluble variants (i.e. transmembrane domains deleted or inactivated), or is complementary to such encoding nucleic acid molecule. Transmembrane domains has been tentatively identified as being located at about amino acid positions 8–30, 82–102, 121–140, and 166–186 in the PRO1488 amino acid sequence (FIG. 190, SEQ ID NO:330).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 220, inclusive of FIG. 190 (SEQ ID NO:330), or (b) the complement of the DNA of (a).

Another embodiment is directed to fragments of a PRO1488 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1488 polypeptide encoded by any of the isolated nucleic acid sequences hereinabove defined.

In a specific aspect, the invention provides isolated native sequence PRO1488 polypeptide, which in one embodiment, includes an amino acid sequence comprising residues 1 to 220 of FIG. 190 (SEQ ID NO:330).

In another aspect, the invention concerns an isolated PRO1488 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 220, inclusive of FIG. 190 (SEQ ID NO:330).

In a further aspect, the invention concerns an isolated PRO1488 polypeptide, comprising an amino acid sequence scoring at least about 80% positives, preferably at least about 85% positives, more preferably at least about 90% positives, most preferably at least about 95% positives when compared with the amino acid sequence of residues 1 to 220 of FIG. 190 (SEQ ID NO:330).

In yet another aspect, the invention concerns an isolated PRO1488 polypeptide, comprising the sequence of amino acid residues 1 to about 220, inclusive of FIG. 190 (SEQ ID NO:330), or a fragment thereof sufficient to provide a binding site for an anti-PRO1488 antibody. Preferably, the PRO1488 fragment retains a qualitative biological activity of a native PRO1488 polypeptide.

In a still further aspect, the invention provides a polypeptide produced by (i) hybridizing a test DNA molecule under stringent conditions with (a) a DNA molecule encoding a PRO1488 polypeptide having the sequence of amino acid residues from about 1 to about 220, inclusive of FIG. 190 (SEQ ID NO:330), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1488 polypeptide. In a particular embodiment, the agonist or antagonist is an anti-PRO1488 antibody.

In a further embodiment, the invention concerns a method of identifying agonists or antagonists of a native PRO1488 polypeptide, by contacting the native PRO1488 polypeptide with a candidate molecule and monitoring a biological activity mediated by said polypeptide.

In a still further embodiment, the invention concerns a composition comprising a PRO1488 polypeptide, or an agonist or antagonist as hereinabove defined, in combination with a pharmaceutically acceptable carrier.

96. PRO1489

A cDNA clone (DNA73737-1658) has been identified, having homology to nucleic acid encoding the clostridium perfringens enterotoxin receptor (CPE-R) that encodes a novel polypeptide, designated in the present application as "PRO1489".

In one embodiment, the invention provides an isolated nucleic acid molecule comprising DNA encoding a PRO1489 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1489 polypeptide having the sequence of amino acid residues from about 1 to about 173, inclusive of FIG. 192 (SEQ ID NO:332), or (b) the complement of the DNA molecule of (a).

In another aspect, the invention concerns an isolated nucleic acid molecule encoding a PRO1489 polypeptide comprising DNA hybridizing to the complement of the nucleic acid between about nucleotides 264 and about 782, inclusive, of FIG. 191 (SEQ ID NO:331). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203412 (DNA73737-1658) or (b) the complement of the nucleic acid molecule of (a). In a preferred embodiment, the nucleic acid comprises a DNA encoding the same mature polypeptide encoded by the human protein cDNA in ATCC Deposit No. 203412 (DNA73737-1658).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 to about 173, inclusive of FIG. 192 (SEQ ID NO:332), or (b) the complement of the DNA of (a).

In a further aspect, the invention concerns an isolated nucleic acid molecule having at least 25 nucleotides and produced by hybridizing a test DNA molecule under stringent conditions with (a) a DNA molecule encoding a PRO1489 polypeptide having the sequence of amino acid residues from 1 to about 173, inclusive of FIG. 192 (SEQ ID NO:332), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1489 polypeptide, with or without the initiating methionine, and its soluble, i.e., transmembrane domain deleted or inactivated variants, or is complementary to such encoding nucleic acid molecule. The transmembrane domains have been tentatively identified as extending from about amino acid position 31 to about amino acid position 51, from about amino acid position 71 to about amino acid position 90 and from about amino acid position 112 to about amino acid position 133 in the PRO1489 amino acid sequence (FIG. 192, SEQ ID NO:332).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 173, inclusive of FIG. 192 (SEQ ID NO:332), or (b) the complement of the DNA of (a).

Another embodiment is directed to fragments of a PRO1489 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 191 (SEQ ID NO:331).

In another embodiment, the invention provides isolated PRO1489 polypeptide encoded by any of the isolated nucleic acid sequences hereinabove identified.

In a specific aspect, the invention provides isolated native sequence PRO1489 polypeptide, which in certain embodiments, includes an amino acid sequence comprising residues 1 to about 173 of FIG. 192 (SEQ ID NO:332).

In another aspect, the invention concerns an isolated PRO1489 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 173, inclusive of FIG. 192 (SEQ ID NO:332).

In a further aspect, the invention concerns an isolated PRO1489 polypeptide, comprising an amino acid sequence scoring at least about 80% positives, preferably at least about 85% positives, more preferably at least about 90% positives, most preferably at least about 95% positives when compared with the amino acid sequence of residues 1 to about 173, inclusive of FIG. 192 (SEQ ID NO:332).

In yet another aspect, the invention concerns an isolated PRO1489 polypeptide, comprising the sequence of amino acid residues 1 to about 173, inclusive of FIG. 192 (SEQ ID NO:332), or a fragment thereof sufficient to provide a binding site for an anti-PRO1489 antibody. Preferably, the PRO1489 fragment retains a qualitative biological activity of a native PRO1489 polypeptide.

In a still further aspect, the invention provides a polypeptide produced by (i) hybridizing a test DNA molecule under stringent conditions with (a) a DNA molecule encoding a PRO1489 polypeptide having the sequence of amino acid residues from about 1 to about 173, inclusive of FIG. 192 (SEQ ID NO:332), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1489 polypeptide. In a particular embodiment, the agonist or antagonist is an anti-PRO1489 antibody.

In a further embodiment, the invention concerns a method of identifying agonists or antagonists of a native PRO1489 polypeptide by contacting the native PRO1489 polypeptide with a candidate molecule and monitoring a biological activity mediated by said polypeptide.

In a still further embodiment, the invention concerns a composition comprising a PRO1489 polypeptide, or an agonist or antagonist as hereinabove defined, in combination with a pharmaceutically acceptable carrier.

97. PRO1474

A cDNA clone (DNA73739-1645) has been identified that encodes a novel polypeptide having sequence identity with ovomucoid and designated in the present application as "PRO1474."

In one embodiment, the invention provides an isolated nucleic acid molecule comprising DNA encoding a PRO1474 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1474 polypeptide having the sequence of amino acid residues from 1 or about 20 to about 85, inclusive of FIG. 194 (SEQ ID NO:334), or (b) the complement of the DNA molecule of (a).

In another aspect, the invention concerns an isolated nucleic acid molecule encoding a PRO1474 polypeptide comprising DNA hybridizing to the complement of the nucleic acid between about residues 102 and about 299, inclusive, of FIG. 193 (SEQ ID NO:333). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203270 (DNA73739-1645), or (b) the complement of the DNA molecule of (a). In a preferred embodiment, the nucleic acid comprises a DNA encoding the same mature polypeptide encoded by the human protein cDNA in ATCC Deposit No. 203270 (DNA73739-1645).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 85, inclusive of FIG. 194 (SEQ ID NO:334), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1474 polypeptide having the sequence of amino acid residues from about 20 to about 85, inclusive of FIG. 194 (SEQ ID NO:334), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 85, inclusive of FIG. 194 (SEQ ID NO:334), or (b) the complement of the DNA of (a).

Another embodiment is directed to fragments of a PRO1474 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1474 polypeptide encoded by any of the isolated nucleic acid sequences hereinabove defined.

In a specific aspect, the invention provides isolated native sequence PRO1474 polypeptide, which in one embodiment, includes an amino acid sequence comprising residues 20 through 85 of FIG. 194 (SEQ ID NO:334).

In another aspect, the invention concerns an isolated PRO1474 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 85, inclusive of FIG. 194 (SEQ ID NO:334).

In a further aspect, the invention concerns an isolated PRO1474 polypeptide, comprising an amino acid sequence scoring at least about 80% positives, preferably at least about 85% positives, more preferably at least about 90% positives, most preferably at least about 95% positives when compared with the amino acid sequence of residues 20 through 85 of FIG. 194 (SEQ ID NO:334).

In yet another aspect, the invention concerns an isolated PRO1474 polypeptide, comprising the sequence of amino acid residues 20 to about 85, inclusive of FIG. 194 (SEQ ID NO:334), or a fragment thereof sufficient to provide a binding site for an anti-PRO1474 antibody. Preferably, the PRO1474 fragment retains a qualitative biological activity of a native PRO1474 polypeptide.

In a still further aspect, the invention provides a polypeptide produced by (i) hybridizing a test DNA molecule under stringent conditions with (a) a DNA molecule encoding a PRO1474 polypeptide having the sequence of amino acid residues from about 20 to about 85, inclusive of FIG. 194 (SEQ ID NO:334), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1474 polypeptide. In a particular embodiment, the agonist or antagonist is an anti-PRO1474 antibody.

In a further embodiment, the invention concerns a method of identifying agonists or antagonists of a native PRO1474 polypeptide, by contacting the native PRO1474 polypeptide with a candidate molecule and monitoring a biological activity mediated by said polypeptide.

In a still further embodiment, the invention concerns a composition comprising a PRO1474 polypeptide, or an agonist or antagonist as hereinabove defined, in combination with a pharmaceutically acceptable carrier.

98. PRO1508

A cDNA clone (DNA73742-1662) has been identified that encodes a novel secreted polypeptide and designated in the present application as "PRO1508."

In one embodiment, the invention provides an isolated nucleic acid molecule comprising DNA encoding a PRO1508 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1508 polypeptide having the sequence of amino acid residues from 1 or about 31 to about 148, inclusive of FIG. 196 (SEQ ID NO:336), or (b) the complement of the DNA molecule of (a).

In another aspect, the invention concerns an isolated nucleic acid molecule encoding a PRO1508 polypeptide comprising DNA hybridizing to the complement of the nucleic acid between about residues 160 and about 513, inclusive, of FIG. 195 (SEQ ID NO:335). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203316 (DNA73742-1662), or (b) the complement of the DNA molecule of (a). In a preferred embodiment, the nucleic acid comprises a DNA encoding the same mature polypeptide encoded by the human protein cDNA in ATCC Deposit No. 203316 (DNA73742-1662).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 31 to about 148, inclusive of FIG. 196 (SEQ ID NO:336), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1508 polypeptide having the sequence of amino acid residues from about 31 to about 148, inclusive of FIG. 196 (SEQ ID NO:336), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1508 polypeptide, with or without the N-terminal signal sequence and/or the initiating methionine, or is complementary to such encoding nucleic acid molecule. The signal peptide has been tentatively identified as extending from amino acid position 1 through about amino acid position 30 in the sequence of FIG. 196 (SEQ ID NO:336).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 31 to about 148, inclusive of FIG. 196 (SEQ ID NO:336), or (b) the complement of the DNA of (a).

Another embodiment is directed to fragments of a PRO1508 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1508 polypeptide encoded by any of the isolated nucleic acid sequences hereinabove defined.

In a specific aspect, the invention provides isolated native sequence PRO1508 polypeptide, which in one embodiment, includes an amino acid sequence comprising residues 31 to 148 of FIG. 196 (SEQ ID NO:336).

In another aspect, the invention concerns an isolated PRO1508 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 31 to about 148, inclusive of FIG. 196 (SEQ ID NO:336).

In a further aspect, the invention concerns an isolated PRO1508 polypeptide, comprising an amino acid sequence scoring at least about 80% positives, preferably at least about 85% positives, more preferably at least about 90% positives, most preferably at least about 95% positives when compared with the amino acid sequence of residues 31 to 148 of FIG. 196 (SEQ ID NO:336).

In yet another aspect, the invention concerns an isolated PRO1508 polypeptide, comprising the sequence of amino acid residues 31 to about 148, inclusive of FIG. 196 (SEQ ID NO:336), or a fragment thereof sufficient to provide a binding site for an anti-PRO1508 antibody. Preferably, the PRO1508 fragment retains a qualitative biological activity of a native PRO1508 polypeptide.

In a still further aspect, the invention provides a polypeptide produced by (i) hybridizing a test DNA molecule under stringent conditions with (a) a DNA molecule encoding a PRO1508 polypeptide having the sequence of amino acid residues from about 31 to about 148, inclusive of FIG. 196 (SEQ ID NO:336), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

99. PRO1555

A cDNA clone (DNA73744-1665) has been identified that encodes a novel transmembrane polypeptide designated in the present application as "PRO1555".

In one embodiment, the invention provides an isolated nucleic acid molecule comprising DNA encoding a PRO1555 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1555 polypeptide having the sequence of amino acid residues from 1 or about 32 to about 246, inclusive of FIG. 198 (SEQ ID NO:338), or (b) the complement of the DNA molecule of (a).

In another aspect, the invention concerns an isolated nucleic acid molecule encoding a PRO1555 polypeptide comprising DNA hybridizing to the complement of the nucleic acid between about residues 83 and about 827, inclusive, of FIG. 197 (SEQ ID NO:337). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203322 (DNA73744-1665), or (b) the complement of the DNA molecule of (a). In a preferred embodiment, the nucleic acid comprises a DNA encoding the same mature polypeptide encoded by the human protein cDNA in ATCC Deposit No. 203322 (DNA73744-1665).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 32 to about 246, inclusive of FIG. 198 (SEQ ID NO:338), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1555 polypeptide having the sequence of amino acid residues from about 32 to about 246, inclusive of FIG. 198 (SEQ ID NO:338), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1555 polypeptide, with or without the N-terminal signal sequence and/or the initiating methionine, and its soluble variants (i.e. transmembrane domains deleted or inactivated), or is complementary to such encoding nucleic acid molecule. The signal peptide has been tentatively identified as extending from amino acid position 1 through about amino acid position 31 in the sequence of FIG. 198 (SEQ ID NO:338). Two transmembrane domains have been tentatively identified as extending from about amino acid position 1 to about amino acid position 32, and from about amino acid position 195 through about amino acid position 217, in the PRO1555 amino acid sequence (FIG. 198, SEQ ID NO:338).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 32 to about 246, inclusive of FIG. 198 (SEQ ID NO:338), or (b) the complement of the DNA of (a).

Another embodiment is directed to fragments of a PRO1555 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1555 polypeptide encoded by any of the isolated nucleic acid sequences hereinabove defined.

In a specific aspect, the invention provides isolated native sequence PRO1555 polypeptide, which in one embodiment, includes an amino acid sequence comprising residues 32 to 246 of FIG. 198 (SEQ ID NO:338).

In another aspect, the invention concerns an isolated PRO1555 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 32 to about 246, inclusive of FIG. 198 (SEQ ID NO:338).

In a further aspect, the invention concerns an isolated PRO1555 polypeptide, comprising an amino acid sequence scoring at least about 80% positives, preferably at least about 85% positives, more preferably at least about 90% positives, most preferably at least about 95% positives when compared with the amino acid sequence of residues 32 to 246 of FIG. 198 (SEQ ID NO:338).

In yet another aspect, the invention concerns an isolated PRO1555 polypeptide, comprising the sequence of amino acid residues 32 to about 246, inclusive of FIG. 198 (SEQ ID NO:338), or a fragment thereof sufficient to provide a binding site for an anti-PRO1555 antibody. Preferably, the PRO1555 fragment retains a qualitative biological activity of a native PRO1555 polypeptide.

In a still further aspect, the invention provides a polypeptide produced by (i) hybridizing a test DNA molecule under stringent conditions with (a) a DNA molecule encoding a PRO1555 polypeptide having the sequence of amino acid residues from about 32 to about 246, inclusive of FIG. 198 (SEQ ID NO:338), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

100. PRO1485

A cDNA clone (DNA73746-1654) has been identified that encodes a novel polypeptide having sequence identity with lysozyme, and more particularly, lysozyme C precursor, and designated in the present application as "PRO1485."

In one embodiment, the invention provides an isolated nucleic acid molecule comprising DNA encoding a PRO1485 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1485 polypeptide having the sequence of amino acid residues from 1 or about 19 to about 148, inclusive of FIG. 200 (SEQ ID NO:340), or (b) the complement of the DNA molecule of (a).

In another aspect, the invention concerns an isolated nucleic acid molecule encoding a PRO1485 polypeptide comprising DNA hybridizing to the complement of the nucleic acid between about residues 205 and about 594, inclusive, of FIG. 199 (SEQ ID NO:339). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203411 (DNA73746-1654), or (b) the complement of the DNA molecule of (a). In a preferred embodiment, the nucleic acid comprises a DNA encoding the same mature polypeptide encoded by the human protein cDNA in ATCC Deposit No. 203411 (DNA73746-1654).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 148, inclusive of FIG. 200 (SEQ ID NO:340), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1485 polypeptide having the sequence of amino acid residues from about 19 to about 148, inclusive of FIG. 200 (SEQ ID NO:340), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 148, inclusive of FIG. 200 (SEQ ID NO:340), or (b) the complement of the DNA of (a).

Another embodiment is directed to fragments of a PRO1485 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1485 polypeptide encoded by any of the isolated nucleic acid sequences hereinabove defined.

In a specific aspect, the invention provides isolated native sequence PRO1485 polypeptide, which in one embodiment, includes an amino acid sequence comprising residues 19 through 148 of FIG. 200 (SEQ ID NO:340).

In another aspect, the invention concerns an isolated PRO1485 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 148, inclusive of FIG. 200 (SEQ ID NO:340).

In a further aspect, the invention concerns an isolated PRO1485 polypeptide, comprising an amino acid sequence scoring at least about 80% positives, preferably at least about 85% positives, more preferably at least about 90% positives, most preferably at least about 95% positives when compared with the amino acid sequence of residues 19 through 148 of FIG. 200 (SEQ ID NO:340).

In yet another aspect, the invention concerns an isolated PRO1485 polypeptide, comprising the sequence of amino acid residues 19 to about 148, inclusive of FIG. 200 (SEQ ID NO:340), or a fragment thereof sufficient to provide a binding site for an anti-PRO1485 antibody. Preferably, the PRO1485 fragment retains a qualitative biological activity of a native PRO1485 polypeptide.

In a still further aspect, the invention provides a polypeptide produced by (i) hybridizing a test DNA molecule under stringent conditions with (a) a DNA molecule encoding a PRO1485 polypeptide having the sequence of amino acid residues from about 19 to about 148, inclusive of FIG. 200 (SEQ ID NO:340), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1485 polypeptide. In a particular embodiment, the agonist or antagonist is an anti-PRO1485 antibody.

In a further embodiment, the invention concerns a method of identifying agonists or antagonists of a native PRO1485 polypeptide, by contacting the native PRO1485 polypeptide with a candidate molecule and monitoring a biological activity mediated by said polypeptide.

In a still further embodiment, the invention concerns a composition comprising a PRO1485 polypeptide, or an agonist or antagonist as hereinabove defined, in combination with a pharmaceutically acceptable carrier.

101. PRO1564

A cDNA clone (DNA73760-1672) has been identified, having homology to nucleic acid encoding an N-acetylgalactosaminyltransferase protein that encodes a novel polypeptide, designated in the present application as "PRO1564".

In one embodiment, the invention provides an isolated nucleic acid molecule comprising DNA encoding a PRO1564 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1564 polypeptide having the sequence of amino acid residues from about 1 or about 29 to about 639, inclusive of FIG. 202 (SEQ ID NO:347), or (b) the complement of the DNA molecule of (a).

In another aspect, the invention concerns an isolated nucleic acid molecule encoding a PRO1564 polypeptide comprising DNA hybridizing to the complement of the nucleic acid between about nucleotides 462 or about 546 and about 2378, inclusive, of FIG. 201 (SEQ ID NO:346). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203314 (DNA73760-1672) or (b) the complement of the nucleic acid molecule of (a). In a preferred embodiment, the nucleic acid comprises a DNA encoding the same mature polypeptide encoded by the human protein cDNA in ATCC Deposit No. 203314 (DNA73760-1672).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 29 to about 639, inclusive of FIG. 202 (SEQ ID NO:347), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1564 polypeptide having the sequence of amino acid residues from 1 or about 29 to about 639, inclusive of FIG. 202 (SEQ ID NO:347), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1564 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 28 in the sequence of FIG. 202 (SEQ ID NO:347). The transmembrane domain has been tentatively identified as extending from about amino acid position 11 to about amino acid position 36 in the PRO1564 amino acid sequence (FIG. 202, SEQ ID NO:347).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 29 to about 639, inclusive of FIG. 202 (SEQ ID NO:347), or (b) the complement of the DNA of (a).

Another embodiment is directed to fragments of a PRO1564 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 201 (SEQ ID NO:346).

In another embodiment, the invention provides isolated PRO1564 polypeptide encoded by any of the isolated nucleic acid sequences hereinabove identified.

In a specific aspect, the invention provides isolated native sequence PRO1564 polypeptide, which in certain embodiments, includes an amino acid sequence comprising residues 1 or about 29 to about 639 of FIG. 202 (SEQ ID NO:347).

In another aspect, the invention concerns an isolated PRO1564 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 29 to about 639, inclusive of FIG. 202 (SEQ ID NO:347).

In a further aspect, the invention concerns an isolated PRO1564 polypeptide, comprising an amino acid sequence scoring at least about 80% positives, preferably at least about 85% positives, more preferably at least about 90% positives, most preferably at least about 95% positives when compared with the amino acid sequence of residues 1 or about 29 to about 639, inclusive of FIG. 202 (SEQ ID NO:347).

In yet another aspect, the invention concerns an isolated PRO1564 polypeptide, comprising the sequence of amino acid residues 1 or about 29 to about 639, inclusive of FIG. 202 (SEQ ID NO:347), or a fragment thereof sufficient to provide a binding site for an anti-PRO1564 antibody. Preferably, the PRO1564 fragment retains a qualitative biological activity of a native PRO1564 polypeptide.

In a still further aspect, the invention provides a polypeptide produced by (i) hybridizing a test DNA molecule under stringent conditions with (a) a DNA molecule encoding a PRO1564 polypeptide having the sequence of amino acid residues from about 1 or about 29 to about 639, inclusive of FIG. 202 (SEQ ID NO:347), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1564 polypeptide. In a particular embodiment, the agonist or antagonist is an anti-PRO1564 antibody.

In a further embodiment, the invention concerns a method of identifying agonists or antagonists of a native PRO1564 polypeptide by contacting the native PRO1564 polypeptide with a candidate molecule and monitoring a biological activity mediated by said polypeptide.

In a still further embodiment, the invention concerns a composition comprising a PRO1564 polypeptide, or an agonist or antagonist as hereinabove defined, in combination with a pharmaceutically acceptable carrier.

102. PRO1755

A cDNA clone (DNA76396-1698) has been identified that encodes a novel transmembrane polypeptide designated in the present application as "PRO1755".

In one embodiment, the invention provides an isolated nucleic acid molecule comprising DNA encoding a PRO1755 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1755 polypeptide having the sequence of amino acid residues from 1 or about 32 to about 276, inclusive of FIG. 204 (SEQ ID NO:352), or (b) the complement of the DNA molecule of (a).

In another aspect, the invention concerns an isolated nucleic acid molecule encoding a PRO1755 polypeptide comprising DNA hybridizing to the complement of the nucleic acid between about residues 151 and about 885, inclusive, of FIG. 203 (SEQ ID NO:351). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203471 (DNA76396-1698), or (b) the complement of the DNA molecule of (a). In a preferred embodiment, the nucleic acid comprises a DNA encoding the same mature polypeptide encoded by the human protein cDNA in ATCC Deposit No. 203471 (DNA76396-1698).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 32 to about 276, inclusive of FIG. 204 (SEQ ID NO:352), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1755 polypeptide having the sequence of amino acid residues from about 32 to about 276, inclusive of FIG. 204 (SEQ ID NO:352), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1755 polypeptide, with or without the N-terminal signal sequence and/or the initiating methionine, and its soluble variants (i.e. transmembrane domain deleted or inactivated), or is complementary to such encoding nucleic acid molecule. The signal peptide has been tentatively identified as extending from amino acid position 1 through about amino acid position 31 in the sequence of FIG. 204 (SEQ ID NO:352). The transmembrane domain has been tentatively identified as extending from about amino acid position 178 to about amino acid position 198 in the PRO1755 amino acid sequence (FIG. 204, SEQ ID NO:352).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 32 to about 276, inclusive of FIG. 204 (SEQ ID NO:352), or (b) the complement of the DNA of (a).

Another embodiment is directed to fragments of a PRO1755 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1755 polypeptide encoded by any of the isolated nucleic acid sequences hereinabove defined.

In a specific aspect, the invention provides isolated native sequence PRO1755 polypeptide, which in one embodiment, includes an amino acid sequence comprising residues 32 to 276 of FIG. 204 (SEQ ID NO:352).

In another aspect, the invention concerns an isolated PRO1755 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 32 to about 276, inclusive of FIG. 204 (SEQ ID NO:352).

In a further aspect, the invention concerns an isolated PRO1755 polypeptide, comprising an amino acid sequence scoring at least about 80% positives, preferably at least about 85% positives, more preferably at least about 90% positives, most preferably at least about 95% positives when compared with the amino acid sequence of residues 32 to 276 of FIG. 204 (SEQ ID NO:352).

In yet another aspect, the invention concerns an isolated PRO1755 polypeptide, comprising the sequence of amino acid residues 32 to about 276, inclusive of FIG. 204 (SEQ ID NO:352), or a fragment thereof sufficient to provide a binding site for an anti-PRO1755 antibody. Preferably, the PRO1755 fragment retains a qualitative biological activity of a native PRO1755 polypeptide.

In a still further aspect, the invention provides a polypeptide produced by (i) hybridizing a test DNA molecule under stringent conditions with (a) a DNA molecule encoding a PRO1755 polypeptide having the sequence of amino acid residues from about 32 to about 276, inclusive of FIG. 204 (SEQ ID NO:352), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1755 polypeptide. In a particular embodiment, the agonist or antagonist is an anti-PRO1755 antibody.

In a further embodiment, the invention concerns a method of identifying agonists or antagonists of a native PRO1755 polypeptide, by contacting the native PRO1755 polypeptide with a candidate molecule and monitoring a biological activity mediated by said polypeptide.

In a still further embodiment, the invention concerns a composition comprising a PRO1755 polypeptide, or an agonist or antagonist as hereinabove defined, in combination with a pharmaceutically acceptable carrier.

103. PRO1757

A cDNA clone (DNA76398-1699) has been identified that encodes a novel transmembrane polypeptide, designated in the present application as "PRO1757".

In one embodiment, the invention provides an isolated nucleic acid molecule comprising DNA encoding a PRO1757 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1757 polypeptide having the sequence of amino acid residues from about 1 or about 20 to about 121, inclusive of FIG. 206 (SEQ ID NO:354), or (b) the complement of the DNA molecule of (a).

In another aspect, the invention concerns an isolated nucleic acid molecule encoding a PRO1757 polypeptide comprising DNA hybridizing to the complement of the nucleic acid between about nucleotides 59 or about 116 and about 121, inclusive, of FIG. 205 (SEQ ID NO:353). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203474 (DNA76398-1699) or (b) the complement of the nucleic acid molecule of (a). In a preferred embodiment, the nucleic acid comprises a DNA encoding the same mature polypeptide encoded by the human protein cDNA in ATCC Deposit No. 203474 (DNA76398-1699).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 20 to about 121, inclusive of FIG. 206 (SEQ ID NO:354), or (b) the complement of the DNA of (a).

In a further aspect, the invention concerns an isolated nucleic acid molecule having at least 125 nucleotides and produced by hybridizing a test DNA molecule under stringent conditions with (a) a DNA molecule encoding a PRO1757 polypeptide having the sequence of amino acid residues from 1 or about 20 to about 121, inclusive of FIG. 206 (SEQ ID NO:354), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1757 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 19 in the sequence of FIG. 206 (SEQ ID NO:354). The transmembrane domain has been tentatively identified as extending from about amino acid position 91 to about amino acid position 110 in the PRO1757 amino acid sequence (FIG. 206, SEQ ID NO:354).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 20 to about 121, inclusive of FIG. 206 (SEQ ID NO:354), or (b) the complement of the DNA of (a).

Another embodiment is directed to fragments of a PRO1757 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 205 (SEQ ID NO:353).

In another embodiment, the invention provides isolated PRO1757 polypeptide encoded by any of the isolated nucleic acid sequences hereinabove identified.

In a specific aspect, the invention provides isolated native sequence PRO1757 polypeptide, which in certain embodiments, includes an amino acid sequence comprising residues 1 or about 20 to about 121 of FIG. 206 (SEQ ID NO:354).

In another aspect, the invention concerns an isolated PRO1757 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 20 to about 121, inclusive of FIG. 206 (SEQ ID NO:354).

In a further aspect, the invention concerns an isolated PRO1757 polypeptide, comprising an amino acid sequence scoring at least about 80% positives, preferably at least about 85% positives, more preferably at least about 90% positives, most preferably at least about 95% positives when compared with the amino acid sequence of residues 1 or about 20 to about 121, inclusive of FIG. 206 (SEQ ID NO:354).

In yet another aspect, the invention concerns an isolated PRO1757 polypeptide, comprising the sequence of amino acid residues 1 or about 20 to about 121, inclusive of FIG. 206 (SEQ ID NO:354), or a fragment thereof sufficient to provide a binding site for an anti-PRO1757 antibody. Preferably, the PRO1757 fragment retains a qualitative biological activity of a native PRO1757 polypeptide.

In a still further aspect, the invention provides a polypeptide produced by (i) hybridizing a test DNA molecule under stringent conditions with (a) a DNA molecule encoding a PRO1757 polypeptide having the sequence of amino acid residues from about 1 or about 20 to about 121, inclusive of FIG. 206 (SEQ ID NO:354), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1757 polypeptide. In a particular embodiment, the agonist or antagonist is an anti-PRO1757 antibody.

In a further embodiment, the invention concerns a method of identifying agonists or antagonists of a native PRO1757 polypeptide by contacting the native PRO1757 polypeptide with a candidate molecule and monitoring a biological activity mediated by said polypeptide.

In a still further embodiment, the invention concerns a composition comprising a PRO1757 polypeptide, or an agonist or antagonist as hereinabove defined, in combination with a pharmaceutically acceptable carrier.

104. PRO1758

A cDNA clone (DNA76399-1700) has been identified that encodes a novel secreted polypeptide designated in the present application as "PRO1758".

In one embodiment, the invention provides an isolated nucleic acid molecule comprising DNA encoding a PRO1758 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1758 polypeptide having the sequence of amino acid residues from 1 or about 16 to about 157, inclusive of FIG. 208 (SEQ ID NO:356), or (b) the complement of the DNA molecule of (a).

In another aspect, the invention concerns an isolated nucleic acid molecule encoding a PRO1758 polypeptide comprising DNA hybridizing to the complement of the nucleic acid between about residues 123 and about 548, inclusive, of FIG. 207 (SEQ ID NO:355). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203472 (DNA76399-1700), or (b) the complement of the DNA molecule of (a). In a preferred embodiment, the nucleic acid comprises a DNA encoding the same mature polypeptide encoded by the human protein cDNA in ATCC Deposit No. 203472 (DNA76399-1700).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 16 to about 157, inclusive of FIG. 208 (SEQ ID NO:356), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1758 polypeptide having the sequence of amino acid residues from about 16 to about 157, inclusive of FIG. 208 (SEQ ID NO:356), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1758 polypeptide, with or without the N-terminal signal sequence, or is complementary to such encoding nucleic acid molecule. The signal peptide has been tentatively identified as extending from amino acid position 1 through about amino acid position 15 in the sequence of FIG. 208 (SEQ ID NO:356).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 16 to about 157, inclusive of FIG. 208 (SEQ ID NO:356), or (b) the complement of the DNA of (a).

Another embodiment is directed to fragments of a PRO1758 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1758 polypeptide encoded by any of the isolated nucleic acid sequences hereinabove defined.

In a specific aspect, the invention provides isolated native sequence PRO1758 polypeptide, which in one embodiment, includes an amino acid sequence comprising residues 16 to 157 of FIG. 208 (SEQ ID NO:356).

In another aspect, the invention concerns an isolated PRO1758 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 16 to about 157, inclusive of FIG. 208 (SEQ ID NO:356).

In a further aspect, the invention concerns an isolated PRO1758 polypeptide, comprising an amino acid sequence scoring at least about 80% positives, preferably at least about 85% positives, more preferably at least about 90% positives, most preferably at least about 95% positives when compared with the amino acid sequence of residues 16 to 157 of FIG. 208 (SEQ ID NO:356).

In yet another aspect, the invention concerns an isolated PRO1758 polypeptide, comprising the sequence of amino acid residues 16 to about 157, inclusive of FIG. 208 (SEQ ID NO:356), or a fragment thereof sufficient to provide a binding site for an anti-PRO1758 antibody. Preferably, the PRO1758 fragment retains a qualitative biological activity of a native PRO1758 polypeptide.

In a still further aspect, the invention provides a polypeptide produced by (i) hybridizing a test DNA molecule under stringent conditions with (a) a DNA molecule encoding a PRO1758 polypeptide having the sequence of amino acid residues from about 16 to about 157, inclusive of FIG. 208 (SEQ ID NO:356), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

105. PRO1575

A cDNA clone (DNA76401-1683) has been identified that encodes a novel polypeptide having homology to protein disulfide isomerase and designated in the present application as "PRO1575."

In one embodiment, the invention provides an isolated nucleic acid molecule comprising DNA encoding a PRO1575 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1575 polypeptide having the sequence of amino acid residues from 1 or about 21 to about 273, inclusive of FIG. 210 (SEQ ID NO:358), or (b) the complement of the DNA molecule of (a).

In another aspect, the invention concerns an isolated nucleic acid molecule encoding a PRO1575 polypeptide comprising DNA hybridizing to the complement of the nucleic acid between about residues 82 and about 840, inclusive, of FIG. 209 (SEQ ID NO:357). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203360 (DNA76401-1683), or (b) the complement of the DNA molecule of (a). In a preferred embodiment, the nucleic acid comprises a DNA encoding the same mature polypeptide encoded by the human protein cDNA in ATCC Deposit No. 203360 (DNA76401-1683).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 21 to about 273, inclusive of FIG. 210 (SEQ ID NO:358), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1575 polypeptide having the sequence of amino acid residues from about 21 to about 273, inclusive of FIG. 210 (SEQ ID NO:358), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1575 polypeptide, its soluble variants, (i.e. transmembrane domain and/or signal peptide deleted or inactivated) or is complementary to such encoding nucleic acid molecule. The signal peptide has been tentatively identified as extending from amino acid position 1 through about amino acid position 20 in the sequence of FIG. 210 (SEQ ID NO:358). The transmembrane domain has been tentatively identified as extending from about amino acid position 143 to about amino acid position 162 in the PRO1575 amino acid sequence (FIG. 210, SEQ ID NO:358).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 273, inclusive of FIG. 210 (SEQ ID NO:358), or (b) the complement of the DNA of (a).

Another embodiment is directed to fragments of a PRO1575 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1575 polypeptide encoded by any of the isolated nucleic acid sequences hereinabove defined.

In a specific aspect, the invention provides isolated native sequence PRO1575 polypeptide, which in one embodiment, includes an amino acid sequence comprising residues 21 to 273 of FIG. 210 (SEQ ID NO:358).

In another aspect, the invention concerns an isolated PRO1575 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 273, inclusive of FIG. 210 (SEQ ID NO:358).

In a further aspect, the invention concerns an isolated PRO1575 polypeptide, comprising an amino acid sequence scoring at least about 80% positives, preferably at least about 85% positives, more preferably at least about 90% positives, most preferably at least about 95% positives when compared with the amino acid sequence of residues 21 to 273 of FIG. 210 (SEQ ID NO:358).

In yet another aspect, the invention concerns an isolated PRO1575 polypeptide, comprising the sequence of amino acid residues 21 to about 273, inclusive of FIG. 210 (SEQ ID NO:358), or a fragment thereof sufficient to provide a binding site for an anti-PRO1575 antibody. Preferably, the PRO1575 fragment retains a qualitative biological activity of a native PRO1575 polypeptide.

In a still further aspect, the invention provides a polypeptide produced by (i) hybridizing a test DNA molecule under stringent conditions with (a) a DNA molecule encoding a PRO1575 polypeptide having the sequence of amino acid residues from about 21 to about 273, inclusive of FIG. 210 (SEQ ID NO:358), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1575 polypeptide. In a particular embodiment, the agonist or antagonist is an anti-PRO1575 antibody.

In a further embodiment, the invention concerns a method of identifying agonists or antagonists of a native PRO1575 polypeptide, by contacting the native PRO1575 polypeptide with a candidate molecule and monitoring a biological activity mediated by said polypeptide.

In a still further embodiment, the invention concerns a composition comprising a PRO1575 polypeptide, or an agonist or antagonist as hereinabove defined, in combination with a pharmaceutically acceptable carrier.

106. PRO1787

A cDNA clone (DNA76510-2504) has been identified that encodes a novel polypeptide having sequence identity with myelin p0 and designated in the present application as "PRO1787."

In one embodiment, the invention provides an isolated nucleic acid molecule comprising DNA encoding a PRO1787 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1787 polypeptide having the sequence of amino acid residues from 1 or about 38 to about 269, inclusive of FIG. 212 (SEQ ID NO:364), or (b) the complement of the DNA molecule of (a).

In another aspect, the invention concerns an isolated nucleic acid molecule encoding a PRO1787 polypeptide comprising DNA hybridizing to the complement of the nucleic acid between about residues 274 and about 969, inclusive, of FIG. 211 (SEQ ID NO:363). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203477 (DNA76510-2504), or (b) the complement of the DNA molecule of (a). In a preferred embodiment, the nucleic acid comprises a DNA encoding the same mature polypeptide encoded by the human protein cDNA in ATCC Deposit No. 203477 (DNA76510-2504).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 38 to about 269, inclusive of FIG. 212 (SEQ ID NO:364), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1787 polypeptide having the sequence of amino acid residues from about 38 to about 269, inclusive of FIG. 212 (SEQ ID NO:364), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1787 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 37 in the sequence of FIG. 212 (SEQ ID NO:364). The transmembrane domain has been tentatively identified as extending from about amino acid position 161 through about amino acid position 183 in the PRO1787 amino acid sequence (FIG. 212, SEQ ID NO:364).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 38 to about 269, inclusive of FIG. 212 (SEQ ID NO:364), or (b) the complement of the DNA of (a).

Another embodiment is directed to fragments of a PRO1787 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1787 polypeptide encoded by any of the isolated nucleic acid sequences hereinabove defined.

In a specific aspect, the invention provides isolated native sequence PRO1787 polypeptide, which in one embodiment, includes an amino acid sequence comprising residues 38 through 269 of FIG. 212 (SEQ ID NO:364).

In another aspect, the invention concerns an isolated PRO1787 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 38 to about 269, inclusive of FIG. 212 (SEQ ID NO:364).

In a further aspect, the invention concerns an isolated PRO1787 polypeptide, comprising an amino acid sequence scoring at least about 80% positives, preferably at least about 85% positives, more preferably at least about 90% positives, most preferably at least about 95% positives when compared with the amino acid sequence of residues 38 through 269 of FIG. 212 (SEQ ID NO:364).

In yet another aspect, the invention concerns an isolated PRO1787 polypeptide, comprising the sequence of amino acid residues 38 to about 269, inclusive of FIG. 212 (SEQ ID NO:364), or a fragment thereof sufficient to provide a binding site for an anti-PRO1787 antibody. Preferably, the PRO1787 fragment retains a qualitative biological activity of a native PRO1787 polypeptide.

In a still further aspect, the invention provides a polypeptide produced by (i) hybridizing a test DNA molecule under stringent conditions with (a) a DNA molecule encoding a PRO1787 polypeptide having the sequence of amino acid residues from about 38 to about 269, inclusive of FIG. 212 (SEQ ID NO:364), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1787 polypeptide. In a particular embodiment, the agonist or antagonist is an anti-PRO1787 antibody.

In a further embodiment, the invention concerns a method of identifying agonists or antagonists of a native PRO1787 polypeptide, by contacting the native PRO1787 polypeptide with a candidate molecule and monitoring a biological activity mediated by said polypeptide.

In a still further embodiment, the invention concerns a composition comprising a PRO1787 polypeptide, or an agonist or antagonist as hereinabove defined, in combination with a pharmaceutically acceptable carrier.

107. PRO1781

A cDNA clone (DNA76522-2500) has been identified that encodes a novel transmembrane polypeptide designated in the present application as "PRO1781".

In one embodiment, the invention provides an isolated nucleic acid molecule comprising DNA encoding a PRO1781 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1781 polypeptide having the sequence of amino acid residues from 1 or about 20 to about 373, inclusive of FIG. 214 (SEQ ID NO:366), or (b) the complement of the DNA molecule of (a).

In another aspect, the invention concerns an isolated nucleic acid molecule encoding a PRO1781 polypeptide comprising DNA hybridizing to the complement of the nucleic acid between about residues 78 and about 1139, inclusive, of FIG. 213 (SEQ ID NO:365). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203469 (DNA76522-2500), or (b) the complement of the DNA molecule of (a). In a preferred embodiment, the nucleic acid comprises a DNA encoding the same mature polypeptide encoded by the human protein cDNA in ATCC Deposit No. 203469 (DNA76522-2500).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 20 to about 373, inclusive of FIG. 214 (SEQ ID NO:366), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1781 polypeptide having the sequence of amino acid residues from about 20 to about 373, inclusive of FIG. 214 (SEQ ID NO:36), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1781 polypeptide, with or without the N-terminal signal sequence and/or the initiating methionine, and its soluble variants (i.e. transmembrane domain deleted or inactivated), or is complementary to such encoding nucleic acid molecule. The signal peptide has been tentatively identified as extending from amino acid position 1 through about amino acid position 19 in the sequence of FIG. 214 (SEQ ID NO:366). The transmembrane domain has been tentatively identified as extending from about amino acid position 39 to about amino acid position 60 in the PRO1781 amino acid sequence (FIG. 214, SEQ ID NO:366).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 20 to about 373, inclusive of FIG. 214 (SEQ ID NO:366), or (b) the complement of the DNA of (a).

Another embodiment is directed to fragments of a PRO1781 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1781 polypeptide encoded by any of the isolated nucleic acid sequences hereinabove defined.

In a specific aspect, the invention provides isolated native sequence PRO1781 polypeptide, which in one embodiment, includes an amino acid sequence comprising residues 20 to 373 of FIG. 214 (SEQ ID NO:366).

In another aspect, the invention concerns an isolated PRO1781 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 20 to about 373, inclusive of FIG. 214 (SEQ ID NO:366).

In a further aspect, the invention concerns an isolated PRO1781 polypeptide, comprising an amino acid sequence scoring at least about 80% positives, preferably at least about 85% positives, more preferably at least about 90% positives, most preferably at least about 95% positives when compared with the amino acid sequence of residues 20 to 373 of FIG. 214 (SEQ ID NO:366).

In yet another aspect, the invention concerns an isolated PRO1781 polypeptide, comprising the sequence of amino acid residues 20 to about 373, inclusive of FIG. 214 (SEQ ID NO:366), or a fragment thereof sufficient to provide a binding site for an anti-PRO1781 antibody. Preferably, the PRO1781 fragment retains a qualitative biological activity of a native PRO1781 polypeptide.

In a still further aspect, the invention provides a polypeptide produced by (i) hybridizing a test DNA molecule under stringent conditions with (a) a DNA molecule encoding a PRO1781 polypeptide having the sequence of amino acid residues from about 20 to about 373, inclusive of FIG. 214 (SEQ ID NO:366), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

108. PRO1556

A cDNA clone (DNA76529-1666) has been identified that encodes a novel transmembrane polypeptide designated in the present application as "PRO1556".

In one embodiment, the invention provides an isolated nucleic acid molecule comprising DNA encoding a PRO1556 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1556 polypeptide having the sequence of amino acid residues from 1 or about 25 to about 269, inclusive of FIG. 216 (SEQ ID NO:372), or (b) the complement of the DNA molecule of (a).

In another aspect, the invention concerns an isolated nucleic acid molecule encoding a PRO1556 polypeptide comprising DNA hybridizing to the complement of the nucleic acid between about residues 160 and about 891, inclusive, of FIG. 215 (SEQ ID NO:371). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203315 (DNA76529-1666), or (b) the complement of the DNA molecule of (a). In a preferred embodiment, the nucleic acid comprises a DNA encoding the same mature polypeptide encoded by the human protein cDNA in ATCC Deposit No. 203315 (DNA76529-1666).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 25 to about 269, inclusive of FIG. 216 (SEQ ID NO:372), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1556 polypeptide having the sequence of amino acid residues from about 25 to about 269, inclusive of FIG. 216 (SEQ ID NO:372), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1556 polypeptide, with or without the N-terminal signal sequence and/or the initiating methionine, and its soluble variants (i.e. transmembrane domains deleted or inactivated), or is complementary to such encoding nucleic acid molecule. The signal peptide has been tentatively identified as extending from amino acid position 1 through about amino acid position 24 in the sequence of FIG. 216 (SEQ ID NO:372). Two transmembrane domains have been tentatively identified as extending from about amino acid position 11 to about amino acid position 25 and from about amino acid position 226 to about amino acid position 243 in the PRO1556 amino acid sequence (FIG. 216, SEQ ID NO:372).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 25 to about 269, inclusive of FIG. 216 (SEQ ID NO:372), or (b) the complement of the DNA of (a).

Another embodiment is directed to fragments of a PRO1556 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1556 polypeptide encoded by any of the isolated nucleic acid sequences hereinabove defined.

In a specific aspect, the invention provides isolated native sequence PRO1556 polypeptide, which in one embodiment, includes an amino acid sequence comprising residues 25 to 269 of FIG. 216 (SEQ ID NO:372).

In another aspect, the invention concerns an isolated PRO1556 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 25 to about 269, inclusive of FIG. 216 (SEQ ID NO:372).

In a further aspect, the invention concerns an isolated PRO1556 polypeptide, comprising an amino acid sequence scoring at least about 80% positives, preferably at least about 85% positives, more preferably at least about 90% positives, most preferably at least about 95% positives when compared with the amino acid sequence of residues 25 to 269 of FIG. 216 (SEQ ID NO:372).

In yet another aspect, the invention concerns an isolated PRO1556 polypeptide, comprising the sequence of amino acid residues 25 to about 269, inclusive of FIG. 216 (SEQ ID NO:372), or a fragment thereof sufficient to provide a binding site for an anti-PRO1556 antibody. Preferably, the PRO1556 fragment retains a qualitative biological activity of a native PRO1556 polypeptide.

In a still further aspect, the invention provides a polypeptide produced by (i) hybridizing a test DNA molecule under stringent conditions with (a) a DNA molecule encoding a PRO1556 polypeptide having the sequence of amino acid residues from about 25 to about 269, inclusive of FIG. 216 (SEQ ID NO:372), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1556 polypeptide. In a particular embodiment, the agonist or antagonist is an anti-PRO1556 antibody.

In a further embodiment, the invention concerns a method of identifying agonists or antagonists of a native PRO1556 polypeptide, by contacting the native PRO1556 polypeptide with a candidate molecule and monitoring a biological activity mediated by said polypeptide.

In a still further embodiment, the invention concerns a composition comprising a PRO1556 polypeptide, or an agonist or antagonist as hereinabove defined, in combination with a pharmaceutically acceptable carrier.

109. PRO1759

A cDNA clone (DNA76531-1701) has been identified that encodes a novel polypeptide having multiple transmembrane domains, designated in the present application as "PRO1759."

In one embodiment, the invention provides an isolated nucleic acid molecule comprising DNA encoding a PRO1759 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1759 polypeptide having the sequence of amino acid residues from 1 or about 19 to about 450, inclusive of FIG. 218 (SEQ ID NO:374), or (b) the complement of the DNA molecule of (a).

In another aspect, the invention concerns an isolated nucleic acid molecule encoding a PRO1759 polypeptide comprising DNA hybridizing to the complement of the nucleic acid between about residues 179 and about 1474, inclusive, of FIG. 217 (SEQ ID NO:373). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203465 (DNA76531-1701), or (b) the complement of the DNA molecule of (a). In a preferred embodiment, the nucleic acid comprises a DNA encoding the same mature polypeptide encoded by the human protein cDNA in ATCC Deposit No. 203465 (DNA76531-1701).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 19 to about 450, inclusive of FIG. 218 (SEQ ID NO:374), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1759 polypeptide having the sequence of amino acid residues from about 19 to about 450, inclusive of FIG. 218 (SEQ ID NO:374), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1759 polypeptide, with or without the N-terminal signal sequence and/or the initiating methionine, and its soluble, i.e. transmembrane domains deleted or inactivated variants, or is complementary to such encoding nucleic acid molecule. The signal peptide has been tentatively identified as extending from amino acid position 1 through about amino acid position 18 in the sequence of FIG. 218 (SEQ ID NO:374). The transmembrane domains have been tentatively identified as being at about amino acids 1–19 (possibly a signal peptide), 41–55, 75–94, 127–143, 191–213, 249–270, 278–299, 314–330, 343–359, 379–394, and 410–430 in the PRO1759 amino acid sequence (FIG. 218, SEQ ID NO:374).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 19 to about 450, inclusive of FIG. 218 (SEQ ID NO:374), or (b) the complement of the DNA of (a).

Another embodiment is directed to fragments of a PRO1759 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1759 polypeptide encoded by any of the isolated nucleic acid sequences hereinabove defined.

In a specific aspect, the invention provides isolated native sequence PRO1759 polypeptide, which in one embodiment, includes an amino acid sequence comprising residues 19 through 450 of FIG. 218 (SEQ ID NO:374).

In another aspect, the invention concerns an isolated PRO1759 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 19 to about 450, inclusive of FIG. 218 (SEQ ID NO:374).

In a further aspect, the invention concerns an isolated PRO1759 polypeptide, comprising an amino acid sequence scoring at least about 80% positives, preferably at least about 85% positives, more preferably at least about 90% positives, most preferably at least about 95% positives when compared with the amino acid sequence of residues 19 through 450 of FIG. 218 (SEQ ID NO:374).

In yet another aspect, the invention concerns an isolated PRO1759 polypeptide, comprising the sequence of amino acid residues 19 to about 450, inclusive of FIG. 218 (SEQ ID NO:374), or a fragment thereof sufficient to provide a binding site for an anti-PRO1759 antibody. Preferably, the PRO1759 fragment retains a qualitative biological activity of a native PRO1759 polypeptide.

In a still further aspect, the invention provides a polypeptide produced by (i) hybridizing a test DNA molecule under stringent conditions with (a) a DNA molecule encoding a PRO1759 polypeptide having the sequence of amino acid residues from about 19 to about 450, inclusive of FIG. 218 (SEQ ID NO:374), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1759 polypeptide. In a particular embodiment, the agonist or antagonist is an anti-PRO1759 antibody.

In a further embodiment, the invention concerns a method of identifying agonists or antagonists of a native PRO1759 polypeptide, by contacting the native PRO1759 polypeptide with a candidate molecule and monitoring a biological activity mediated by said polypeptide.

In a still further embodiment, the invention concerns a composition comprising a PRO1759 polypeptide, or an agonist or antagonist as hereinabove defined, in combination with a pharmaceutically acceptable carrier.

110. PRO1760

A cDNA clone (DNA76532-1702) has been identified that encodes a novel secreted polypeptide, designated in the present application as "PRO1760."

In one embodiment, the invention provides an isolated nucleic acid molecule comprising DNA encoding a PRO1760 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1760 polypeptide having the sequence of amino acid residues from 1 or about 21 to about 188, inclusive of FIG. 220 (SEQ ID NO:376), or (b) the complement of the DNA molecule of (a).

In another aspect, the invention concerns an isolated nucleic acid molecule encoding a PRO1760 polypeptide comprising DNA hybridizing to the complement of the nucleic acid between about residues 120 and about 623, inclusive, of FIG. 219 (SEQ ID NO:375). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203473 (DNA76532-1702), or (b) the complement of the DNA molecule of (a). In a preferred embodiment, the nucleic acid comprises a DNA encoding the same mature polypeptide encoded by the human protein cDNA in ATCC Deposit No. 203473 (DNA76532-1702).

In a still further aspect, the invention concerns an isolated nucleic acid molecule comprising (a) DNA encoding a polypeptide having at least about 80% sequence identity, preferably at, least about 85% sequence identity, more preferably at least about 90% sequence identity, most preferably at least about 95% sequence identity to the sequence of amino acid residues from about 21 to about 188, inclusive of FIG. 220 (SEQ ID NO:376), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1760 polypeptide having the sequence of amino acid residues from about 21 to about 188, inclusive of FIG. 220 (SEQ ID NO:376), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 21 to about 188, inclusive of FIG. 220 (SEQ ID NO:376), or (b) the complement of the DNA of (a).

Another embodiment is directed to fragments of a PRO1760 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1760 polypeptide encoded by any of the isolated nucleic acid sequences hereinabove defined.

In a specific aspect, the invention provides isolated native sequence PRO1760 polypeptide, which in one embodiment, includes an amino acid sequence comprising residues 21 through 188 of FIG. 220 (SEQ ID NO:376).

In another aspect, the invention concerns an isolated PRO1760 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 21 to about 188, inclusive of FIG. 220 (SEQ ID NO:376).

In a further aspect, the invention concerns an isolated PRO1760 polypeptide, comprising an amino acid sequence scoring at least about 80% positives, preferably at least about 85% positives, more preferably at least about 90% positives, most preferably at least about 95% positives when compared with the amino acid sequence of residues 21 through 188 of FIG. 220 (SEQ ID NO:376).

In yet another aspect, the invention concerns an isolated PRO1760 polypeptide, comprising the sequence of amino acid residues 21 to about 188, inclusive of FIG. 220 (SEQ ID NO:376), or a fragment thereof sufficient to provide a binding site for an anti-PRO1760 antibody. Preferably, the PRO1760 fragment retains a qualitative biological activity of a native PRO1760 polypeptide.

In a still further aspect, the invention provides a polypeptide produced by (i) hybridizing a test DNA molecule under stringent conditions with (a) a DNA molecule encoding a PRO1760 polypeptide having the sequence of amino acid residues from about 21 to about 188, inclusive of FIG. 220 (SEQ ID NO:376), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1760 polypeptide. In a particular embodiment, the agonist or antagonist is an anti-PRO1760 antibody.

In a further embodiment, the invention concerns a method of identifying agonists or antagonists of a native PRO1760 polypeptide, by contacting the native PRO1760 polypeptide with a candidate molecule and monitoring a biological activity mediated by said polypeptide.

In a still further embodiment, the invention concerns a composition comprising a PRO1760 polypeptide, or an agonist or antagonist as hereinabove defined, in combination with a pharmaceutically acceptable carrier.

111. PRO1561

A cDNA clone (DNA76538-1670) has been identified, having homology to nucleic acid encoding human phospholipase A2 protein that encodes a novel polypeptide, designated in the present application as "PRO1561".

In one embodiment, the invention provides an isolated nucleic acid molecule comprising DNA encoding a PRO1561 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1561 polypeptide having the sequence of amino acid residues from about 1 or about 18 to about 116, inclusive of FIG. 222 (SEQ ID NO:378), or (b) the complement of the DNA molecule of (a).

In another aspect, the invention concerns an isolated nucleic acid molecule encoding a PRO1561 polypeptide comprising DNA hybridizing to the complement of the nucleic acid between about nucleotides 29 or about 80 and about 376, inclusive, of FIG. 221 (SEQ ID NO:377). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203313 (DNA76538-1670) or (b) the complement of the nucleic acid molecule of (a). In a preferred embodiment, the nucleic acid comprises a DNA encoding the same mature polypeptide encoded by the human protein cDNA in ATCC Deposit No. 203313 (DNA76538-1670).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 18 to about 116, inclusive of FIG. 222 (SEQ ID NO:378), or (b) the complement of the DNA of (a).

In a further aspect, the invention concerns an isolated nucleic acid molecule having at least 100 nucleotides and produced by hybridizing a test DNA molecule under stringent conditions with (a) a DNA molecule encoding a PRO1561 polypeptide having the sequence of amino acid residues from 1 or about 18 to about 116, inclusive of FIG. 222 (SEQ ID NO:378), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1561 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 17 in the sequence of FIG. 222 (SEQ ID NO:378). The transmembrane domain has been tentatively identified as extending from about amino acid position 1 to about amino acid position 24 in the PRO1561 amino acid sequence (FIG. 222, SEQ ID NO:378).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 18 to about 116, inclusive of FIG. 222 (SEQ ID NO:378), or (b) the complement of the DNA of (a).

Another embodiment is directed to fragments of a PRO1561 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 221 (SEQ ID NO:377).

In another embodiment, the invention provides isolated PRO1561 polypeptide encoded by any of the isolated nucleic acid sequences hereinabove identified.

In a specific aspect, the invention provides isolated native sequence PRO1561 polypeptide, which in certain embodiments, includes an amino acid sequence comprising residues 1 or about 18 to about 116 of FIG. 222 (SEQ ID NO:378).

In another aspect, the invention concerns an isolated PRO1561 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 18 to about 116, inclusive of FIG. 222 (SEQ ID NO:378).

In a further aspect, the invention concerns an isolated PRO1561 polypeptide, comprising an amino acid sequence scoring at least about 80% positives, preferably at least about 85% positives, more preferably at least about 90% positives, most preferably at least about 95% positives when compared with the amino acid sequence of residues 1 or about 18 to about 116, inclusive of FIG. 222 (SEQ ID NO:378).

In yet another aspect, the invention concerns an isolated PRO1561 polypeptide, comprising the sequence of amino acid residues 1 or about 18 to about 116, inclusive of FIG. 222 (SEQ ID NO:378), or a fragment thereof sufficient to provide a binding site for an anti-PRO1561 antibody. Preferably, the PRO1561 fragment retains a qualitative biological activity of a native PRO1561 polypeptide.

In a still further aspect, the invention provides a polypeptide produced by (i) hybridizing a test DNA molecule under stringent conditions with (a) a DNA molecule encoding a PRO1561 polypeptide having the sequence of amino acid residues from about 1 or about 18 to about 116, inclusive of FIG. 222 (SEQ ID NO:378), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1561 polypeptide. In a particular embodiment, the agonist or antagonist is an anti-PRO1561 antibody.

In a further embodiment, the invention concerns a method of identifying agonists or antagonists of a native PRO1561 polypeptide by contacting the native PRO1561 polypeptide with a candidate molecule and monitoring a biological activity mediated by said polypeptide.

In a still further embodiment, the invention concerns a composition comprising a PRO1561 polypeptide, or an agonist or antagonist as hereinabove defined, in combination with a pharmaceutically acceptable carrier.

112. PRO1567

A cDNA clone (DNA76541-1675) has been identified that encodes a novel polypeptide having homology to the expression product of the colon specific gene, CSG6, and is designated in the present application as "PRO1567".

In one embodiment, the invention provides an isolated nucleic acid molecule comprising DNA encoding a PRO1567 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1567 polypeptide having the sequence of amino acid residues from 1 or about 23 to about 178, inclusive of FIG. 224 (SEQ ID NO:383), or (b) the complement of the DNA molecule of (a).

In another aspect, the invention concerns an isolated nucleic acid molecule encoding a PRO1567 polypeptide comprising DNA hybridizing to the complement of the nucleic acid between about residues 175 and about 642, inclusive, of FIG. 223 (SEQ ID NO:382). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203409 (DNA76541-1675), or (b) the complement of the DNA molecule of (a). In a preferred embodiment, the nucleic acid comprises a DNA encoding the same mature polypeptide encoded by the human protein cDNA in ATCC Deposit No. 203409 (DNA76541-1675).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 23 to about 178, inclusive of FIG. 224 (SEQ ID NO:383), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1567 polypeptide having the sequence of amino acid residues from about 23 to about 178, inclusive of FIG. 224 (SEQ ID NO:383), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO0567 polypeptide, with or without the N-terminal signal sequence, or is complementary to such encoding nucleic acid molecule. The signal peptide has been tentatively identified as extending from amino acid position 1 through about amino acid position 22 in the sequence of FIG. 224 (SEQ ID NO:383).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 23 to about 178, inclusive of FIG. 224 (SEQ ID NO:383), or (b) the complement of the DNA of (a).

Another embodiment is directed to fragments of a PRO1567 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1567 polypeptide encoded by any of the isolated nucleic acid sequences hereinabove defined.

In a specific aspect, the invention provides isolated native sequence PRO1567 polypeptide, which in one embodiment, includes an amino acid sequence comprising residues 23 to 178 of FIG. 224 (SEQ ID NO:383).

In another aspect, the invention concerns an isolated PRO1567 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 23 to about 178, inclusive of FIG. 224 (SEQ ID NO:383).

In a further aspect, the invention concerns an isolated PRO1567 polypeptide, comprising an amino acid sequence scoring at least about 80% positives, preferably at least about 85% positives, more preferably at least about 90% positives, most preferably at least about 95% positives when compared with the amino acid sequence of residues 23 to 178 of FIG. 224 (SEQ ID NO:383).

In yet another aspect, the invention concerns an isolated PRO1567 polypeptide, comprising the sequence of amino acid residues 23 to about 178, inclusive of FIG. 224 (SEQ ID NO:383), or a fragment thereof sufficient to provide a binding site for an anti-PRO1567 antibody. Preferably, the PRO1567 fragment retains a qualitative biological activity of a native PRO1567 polypeptide.

In a still further aspect, the invention provides a polypeptide produced by (i) hybridizing a test DNA molecule under stringent conditions with (a) a DNA molecule encoding a PRO1567 polypeptide having the sequence of amino acid residues from about 23 to about 178, inclusive of FIG. 224 (SEQ ID NO:383), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1567 polypeptide. In a particular embodiment, the agonist or antagonist is an anti-PRO1567 antibody.

In a further embodiment, the invention concerns a method of identifying agonists or antagonists of a native PRO1567 polypeptide, by contacting the native PRO1567 polypeptide with a candidate molecule and monitoring a biological activity mediated by said polypeptide.

In a still further embodiment, the invention concerns a composition comprising a PRO1567 polypeptide, or an agonist or antagonist as hereinabove defined, in combination with a pharmaceutically acceptable carrier.

113. PRO1693

A cDNA clone (DNA77301-1708) has been identified, having homology to nucleic acid encoding an insulin-like growth factor binding protein that encodes a novel polypeptide, designated in the present application as "PRO1693".

In one embodiment, the invention provides an isolated nucleic acid molecule comprising DNA encoding a PRO1693 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1693 polypeptide having the sequence of amino acid residues from about 1 or about 34 to about 513, inclusive of FIG. 226 (SEQ ID NO:385), or (b) the complement of the DNA molecule of (a).

In another aspect, the invention concerns an isolated nucleic acid molecule encoding a PRO1693 polypeptide comprising DNA hybridizing to the complement of the nucleic acid between about nucleotides 508 or about 607 and about 2046, inclusive, of FIG. 225 (SEQ ID NO:384). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203407 (DNA77301-1708) or (b) the complement of the nucleic acid molecule of (a). In a preferred embodiment, the nucleic acid comprises a DNA encoding the same mature polypeptide encoded by the human protein cDNA in ATCC Deposit No. 203407 (DNA77301-1708).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 34 to about 513, inclusive of FIG. 226 (SEQ ID NO:385), or (b) the complement of the DNA of (a).

In a further aspect, the invention concerns an isolated nucleic acid molecule having at least 175 nucleotides and produced by hybridizing a test DNA molecule under stringent conditions with (a) a DNA molecule encoding a PRO1693 polypeptide having the sequence of amino acid residues from 1 or about 34 to about 513, inclusive of FIG. 226 (SEQ ID NO:385), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1693 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 33 in the sequence of FIG. 226 (SEQ ID NO:385). The transmembrane domain has been tentatively identified as extending from about amino acid position 420 to about amino acid position 442 in the PRO1693 amino acid sequence (FIG. 226, SEQ ID NO:385).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 34 to about 513, inclusive of FIG. 226 (SEQ ID NO:385), or (b) the complement of the DNA of (a).

Another embodiment is directed to fragments of a PRO1693 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 225 (SEQ ID NO:384).

In another embodiment, the invention provides isolated PRO1693 polypeptide encoded by any of the isolated nucleic acid sequences hereinabove identified.

In a specific aspect, the invention provides isolated native sequence PRO1693 polypeptide, which in certain embodiments, includes an amino acid sequence comprising residues 1 or about 34 to about 513 of FIG. 226 (SEQ ID NO:385).

In another aspect, the invention concerns an isolated PRO1693 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 34 to about 513, inclusive of FIG. 226 (SEQ ID NO:385).

In a further aspect, the invention concerns an isolated PRO1693 polypeptide, comprising an amino acid sequence scoring at least about 80% positives, preferably at least about 85% positives, more preferably at least about 90% positives, most preferably at least about 95% positives when compared with the amino acid sequence of residues 1 or about 34 to about 513, inclusive of FIG. 226 (SEQ ID NO:385).

In yet another aspect, the invention concerns an isolated PRO1693 polypeptide, comprising the sequence of amino acid residues 1 or about 34 to about 513, inclusive of FIG. 226 (SEQ ID NO:385), or a fragment thereof sufficient to provide a binding site for an anti-PRO1693 antibody. Preferably, the PRO1693 fragment retains a qualitative biological activity of a native PRO1693 polypeptide.

In a still further aspect, the invention provides a polypeptide produced by (i) hybridizing a test DNA molecule under stringent conditions with (a) a DNA molecule encoding a PRO1693 polypeptide having the sequence of amino acid residues from about 1 or about 34 to about 513, inclusive of FIG. 226 (SEQ ID NO:385), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1693 polypeptide. In a particular embodiment, the agonist or antagonist is an anti-PRO1693 antibody.

In a further embodiment, the invention concerns a method of identifying agonists or antagonists of a native PRO1693 polypeptide by contacting the native PRO1693 polypeptide with a candidate molecule and monitoring a biological activity mediated by said polypeptide.

In a still further embodiment, the invention concerns a composition comprising a PRO1693 polypeptide, or an agonist or antagonist as hereinabove defined, in combination with a pharmaceutically acceptable carrier.

114. PRO1784

A cDNA clone (DNA77303-2502) has been identified that encodes a novel transmembrane polypeptide designated in the present application as "PRO1784."

In one embodiment, the invention provides an isolated nucleic acid molecule comprising DNA encoding a PRO1784 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1784 polypeptide having the sequence of amino acid residues from 1 or about 30 to about 146, inclusive of FIG. 228 (SEQ ID NO:390), or (b) the complement of the DNA molecule of (a).

In another aspect, the invention concerns an isolated nucleic acid molecule encoding a PRO1784 polypeptide comprising DNA hybridizing to the complement of the nucleic acid between about residues 155 and about 505, inclusive, of FIG. 227 (SEQ ID NO:389). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203479 (DNA77303-2502), or (b) the complement of the DNA molecule of (a). In a preferred embodiment, the nucleic acid comprises a DNA encoding the same mature polypeptide encoded by the human protein cDNA in ATCC Deposit No. 203479 (DNA77303-2502).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 30 to about 146, inclusive of FIG. 228 (SEQ ID NO:390), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1784 polypeptide having the sequence of amino acid residues from about 30 to about 146, inclusive of FIG. 228 (SEQ ID NO:390), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1784 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 29 in the sequence of FIG. 228 (SEQ ID NO:390). The transmembrane domain has been tentatively identified as extending from about amino acid position 52 through about amino acid position 70 in the PRO1784 amino acid sequence (FIG. 228, SEQ ID NO:390).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 30 to about 146, inclusive of FIG. 228 (SEQ ID NO:390), or (b) the complement of the DNA of (a).

Another embodiment is directed to fragments of a PRO1784 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1784 polypeptide encoded by any of the isolated nucleic acid sequences hereinabove defined.

In a specific aspect, the invention provides isolated native sequence PRO1784 polypeptide, which in one embodiment, includes an amino acid sequence comprising residues 30 through 146 of FIG. 228 (SEQ ID NO:390).

In another aspect, the invention concerns an isolated PRO1784 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 30 to about 146, inclusive of FIG. 228 (SEQ ID NO:390).

In a further aspect, the invention concerns an isolated PRO1784 polypeptide, comprising an amino acid sequence scoring at least about 80% positives, preferably at least about 85% positives, more preferably at least about 90% positives, most preferably at least about 95% positives when compared with the amino acid sequence of residues 30 through 146 of FIG. 228 (SEQ ID NO:390).

In yet another aspect, the invention concerns an isolated PRO1784 polypeptide, comprising the sequence of amino acid residues 30 to about 146, inclusive of FIG. 228 (SEQ ID NO:390), or a fragment thereof sufficient to provide a binding site for an anti-PRO1784 antibody. Preferably, the PRO1784 fragment retains a qualitative biological activity of a native PRO1784 polypeptide.

In a still further aspect, the invention provides a polypeptide produced by (i) hybridizing a test DNA molecule under stringent conditions with (a) a DNA molecule encoding a PRO1784 polypeptide having the sequence of amino acid residues from about 30 to about 146, inclusive of FIG. 228 (SEQ ID NO:390), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1784 polypeptide. In a particular embodiment, the agonist or antagonist is an anti-PRO1784 antibody.

In a further embodiment, the invention concerns a method of identifying agonists or antagonists of a native PRO1784 polypeptide, by contacting the native PRO1784 polypeptide with a candidate molecule and monitoring a biological activity mediated by said polypeptide.

In a still further embodiment, the invention concerns a composition comprising a PRO1784polypeptide, or an agonist or antagonist as hereinabove defined, in combination with a pharmaceutically acceptable carrier.

115. PRO1605

A cDNA clone (DNA77648-1688) has been identified, having homology to nucleic acid encoding a glycosyltransferase protein that encodes a novel polypeptide, designated in the present application as "PRO1605".

In one embodiment, the invention provides an isolated nucleic acid molecule comprising DNA encoding a PRO1605 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1605 polypeptide having the sequence of amino acid residues from about 1 or about 27 to about 140, inclusive of FIG. 230 (SEQ ID NO:395), or (b) the complement of the DNA molecule of (a).

In another aspect, the invention concerns an isolated nucleic acid molecule encoding a PRO1605 polypeptide comprising DNA hybridizing to the complement of the nucleic acid between about nucleotides 425 or about 503 and about 844, inclusive, of FIG. 229 (SEQ ID NO:394). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit 203408 (DNA77648-1688) or (b) the complement of the nucleic acid molecule of (a). In a preferred embodiment, the nucleic acid comprises a DNA encoding the same mature polypeptide encoded by the human protein cDNA in ATCC Deposit No. 203408 (DNA77648-1688).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 27 to about 140, inclusive of FIG. 230 (SEQ ID NO:395), or (b) the complement of the DNA of (a).

In a further aspect, the invention concerns an isolated nucleic acid molecule having at least 380 nucleotides and produced by hybridizing a test DNA molecule under stringent conditions with (a) a DNA molecule encoding a PRO1605 polypeptide having the sequence of amino acid residues from 1 or about 27 to about 140, inclusive of FIG. 230 (SEQ ID NO:395), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1605 polypeptide, with or without the N-terminal signal sequence and/or the initiating methionine, or is complementary to such encoding nucleic acid molecule. The signal peptide has been tentatively identified as extending from about amino acid position 1 to about amino acid position 26 in the sequence of FIG. 230 (SEQ ID NO:395).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 27 to about 140, inclusive of FIG. 230 (SEQ ID NO:395), or (b) the complement of the DNA of (a).

Another embodiment is directed to fragments of a PRO1605 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 229 (SEQ ID NO:394).

In another embodiment, the invention provides isolated PRO1605 polypeptide encoded by any of the isolated nucleic acid sequences hereinabove identified.

In a specific aspect, the invention provides isolated native sequence PRO1605 polypeptide, which in certain embodiments, includes an amino acid sequence comprising residues 1 or about 27 to about 140 of FIG. 230 (SEQ ID NO:395).

In another aspect, the invention concerns an isolated PRO1605 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 27 to about 140, inclusive of FIG. 230 (SEQ ID NO:395).

In a further aspect, the invention concerns an isolated PRO1605 polypeptide, comprising an amino acid sequence scoring at least about 80% positives, preferably at least about 85% positives, more preferably at least about 90% positives, most preferably at least about 95% positives when compared with the amino acid sequence of residues 1 or about 27 to about 140, inclusive of FIG. 230 (SEQ ID NO:395).

In yet another aspect, the invention concerns an isolated PRO1605 polypeptide, comprising the sequence of amino acid residues 1 or about 27 to about 140, inclusive of FIG. 230 (SEQ ID NO:395), or a fragment thereof sufficient to provide a binding site for an anti-PRO1605 antibody. Preferably, the PRO1605 fragment retains a qualitative biological activity of a native PRO1605 polypeptide.

In a still further aspect, the invention provides a polypeptide produced by (i) hybridizing a test DNA molecule under stringent conditions with (a) a DNA molecule encoding a PRO1605 polypeptide having the sequence of amino acid residues from about 1 or about 27 to about 140, inclusive of FIG. 230 (SEQ ID NO:395), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1605 polypeptide. In a particular embodiment, the agonist or antagonist is an anti-PRO1605 antibody.

In a further embodiment, the invention concerns a method of identifying agonists or antagonists of a native PRO1605 polypeptide by contacting the native PRO1605 polypeptide with a candidate molecule and monitoring a biological activity mediated by said polypeptide.

In a still further embodiment, the invention concerns a composition comprising a PRO1605 polypeptide, or an agonist or antagonist as hereinabove defied, in combination with a pharmaceutically acceptable carrier.

116. PRO1788

A cDNA clone (DNA77652-2505) has been identified that encodes a novel polypeptide having homology to leucine-rich repeat proteins and designated in the present application as "PRO1788."

In one embodiment, the invention provides an isolated nucleic acid molecule comprising DNA encoding a PRO1788 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1788 polypeptide having the sequence of amino acid residues from 1 or about 17 to about 353, inclusive of FIG. 232 (SEQ ID NO:397), or (b) the complement of the DNA molecule of (a).

In another aspect, the invention concerns an isolated nucleic acid molecule encoding a PRO1788 polypeptide comprising DNA hybridizing to the complement of the nucleic acid between about residues 112 and about 1122, inclusive, of FIG. 231 (SEQ ID NO:396). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203480 (DNA77652-2505), or (b) the complement of the DNA molecule of (a). In a preferred embodiment, the nucleic acid comprises a DNA encoding the same mature polypeptide encoded by the human protein cDNA in ATCC Deposit No. 203480 (DNA77652-2505).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 17 to about 353, inclusive of FIG. 232 (SEQ ID NO:397), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1788 polypeptide having the sequence of amino acid residues from about 17 to about 353, inclusive of FIG. 232 (SEQ ID NO:397), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1788 polypeptide, with or without the N-terminal signal sequence and/or the initiating methionine, and its soluble, i.e. transmembrane domain deleted or inactivated variants, or is complementary to such encoding nucleic acid molecule. The signal peptide has been tentatively identified as extending from amino acid position 1 through about amino acid position 16 in the sequence of FIG. 232 (SEQ ID NO:397). Transmembrane domains have been tentatively identified as extending from about amino acid position 215 through about amino acid position 232 and about amino acid position 287 through about amino acid position 304 in the PRO1788 amino acid sequence (FIG. 232, SEQ ID NO:397).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 17 to about 353, inclusive of FIG. 232 (SEQ ID NO:397), or (b) the complement of the DNA of (a).

Another embodiment is directed to fragments of a PRO1788 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1788 polypeptide encoded by any of the isolated nucleic acid sequences hereinabove defined.

In a specific aspect, the invention provides isolated native sequence PRO1788 polypeptide, which in one embodiment, includes an amino acid sequence comprising residues 17 to 353 of FIG. 232 (SEQ ID NO:397).

In another aspect, the invention concerns an isolated PRO1788 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 17 to about 353, inclusive of FIG. 232 (SEQ ID NO:397).

In a further aspect, the invention concerns an isolated PRO1788 polypeptide, comprising an amino acid sequence scoring at least about 80% positives, preferably at least about 85% positives, more preferably at least about 90% positives, most preferably at least about 95% positives when compared with the amino acid sequence of residues 17 to 353 of FIG. 232 (SEQ ID NO:397).

In yet another aspect, the invention concerns an isolated PRO1788 polypeptide, comprising the sequence of amino acid residues 17 to about 353, inclusive of FIG. 232 (SEQ ID NO:397), or a fragment thereof sufficient to provide a binding site for an anti-PRO1788 antibody. Preferably, the PRO1788 fragment retains a qualitative biological activity of a native PRO1788 polypeptide.

In a still further aspect, the invention provides a polypeptide produced by (i) hybridizing a test DNA molecule under stringent conditions with (a) a DNA molecule encoding a PRO1788 polypeptide having the sequence of amino acid residues from about 17 to about 353, inclusive of FIG. 232 (SEQ ID NO:397), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1788 polypeptide. In a particular embodiment, the agonist or antagonist is an anti-PRO1788 antibody.

In a further embodiment, the invention concerns a method of identifying agonists or antagonists of a native PRO1788 polypeptide, by contacting the native PRO1788 polypeptide with a candidate molecule and monitoring a biological activity mediated by said polypeptide.

In a still further embodiment, the invention concerns a composition comprising a PRO1788 polypeptide, or an agonist or antagonist as hereinabove defined, in combination with a pharmaceutically acceptable carrier.

117. PRO1801

A cDNA clone (DNA83500-2506) has been identified, having homology to nucleic acid encoding IL-19 polypeptide, that encodes a novel polypeptide, designated in the present application as "PRO1801".

In one embodiment, the invention provides an isolated nucleic acid molecule comprising DNA encoding a PRO1801 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1801 polypeptide having the sequence of amino acid residues from about 1 or about 43 to about 261, inclusive of FIG. 234 (SEQ ID NO:402), or (b) the complement of the DNA molecule of (a).

In another aspect, the invention concerns an isolated nucleic acid molecule encoding a PRO1801 polypeptide comprising DNA hybridizing to the complement of the nucleic acid between about nucleotides 109 or about 235 and about 891, inclusive, of FIG. 233 (SEQ ID NO:401). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203391 (DNA83500-2506) or (b) the complement of the nucleic acid molecule of (a). In a preferred embodiment, the nucleic acid comprises a DNA encoding the same mature polypeptide encoded by the human protein cDNA in ATCC Deposit No. 203391 (DNA83500-2506).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 43 to about 261, inclusive of FIG. 234 (SEQ ID NO:402), or (b) the complement of the DNA of (a).

In a further aspect, the invention concerns an isolated nucleic acid molecule having at least about 30 nucleotides, usually at least about 50 nucleotides, more usually at least about 100 nucleotides and generally at least about 150 nucleotides and produced by hybridizing a test DNA molecule under stringent conditions with (a) a DNA molecule encoding a PRO1801 polypeptide having the sequence of amino acid residues from 1 or about 43 to about 261, inclusive of FIG. 234 (SEQ ID NO:402), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1801 polypeptide, with or without the N-terminal signal sequence and/or the initiating methionine, or is complementary to such encoding nucleic acid molecule. The signal peptide has been tentatively identified as extending from about amino acid position 1 to about amino acid position 42 in the sequence of FIG. 234 (SEQ ID NO:402).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 43 to about 261, inclusive of FIG. 234 (SEQ ID NO:402), or (b) the complement of the DNA of (a).

Another embodiment is directed to fragments of a PRO1801 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 233 (SEQ ID NO:401).

In another embodiment, the invention provides isolated PRO1801 polypeptide encoded by any of the isolated nucleic acid sequences hereinabove identified.

In a specific aspect, the invention provides isolated native sequence PRO1801 polypeptide, which in certain embodiments, includes an amino acid sequence comprising residues 1 or about 43 to about 261 of FIG. 234 (SEQ ID NO:402).

In another aspect, the invention concerns an isolated PRO1801 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 43 to about 261, inclusive of FIG. 234 (SEQ ID NO:402).

In a further aspect, the invention concerns an isolated PRO1801 polypeptide, comprising an amino acid sequence scoring at least about 80% positives, preferably at least about 85% positives, more preferably at least about 90% positives, most preferably at least about 95% positives when compared with the amino acid sequence of residues 1 or about 43 to about 261, inclusive of FIG. 234 (SEQ ID NO:402).

In yet another aspect, the invention concerns an isolated PRO1801 polypeptide, comprising the sequence of amino acid residues 1 or about 43 to about 261, inclusive of FIG. 234 (SEQ ID NO:402), or a fragment thereof sufficient to provide a binding site for an anti-PRO1801 antibody. Preferably, the PRO1801 fragment retains a qualitative biological activity of a native PRO1801 polypeptide.

In a still further aspect, the invention provides a polypeptide produced by (i) hybridizing a test DNA molecule under stringent conditions with (a) a DNA molecule encoding a PRO1801 polypeptide having the sequence of amino acid residues from about 1 or about 43 to about 261, inclusive of FIG. 234 (SEQ ID NO:402), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1801 polypeptide. In a particular embodiment, the agonist or antagonist is an anti-PRO1801 antibody.

In a further embodiment, the invention concerns a method of identifying agonists or antagonists of a native PRO1801 polypeptide by contacting the native PRO1801 polypeptide with a candidate molecule and monitoring a biological activity mediated by said polypeptide.

In a still further embodiment, the invention concerns a composition comprising a PRO1801 polypeptide, or an agonist or antagonist as hereinabove defined, in combination with a pharmaceutically acceptable carrier.

Another embodiment of the present invention is directed to a method of inhibiting the production of an inflammatory cytokine by a cell capable of producing that inflammatory cytokine, wherein the method comprises the step of contacting the cell with a PRO1801 polypeptide, wherein the production of the inflammatory cytokine is inhibited. The cell may be, for example, a T-cell, an NK cell or a macrophage and the inflammatory cytokine whose production is inhibited may be, for example, IL-1, IL-6, IFN-γ or TNF-α.

A further embodiment of the present invention is directed to a method for the treatment of an individual in need of immunosuppression, wherein the method comprises the step of administering to the individual an immunosuppressive amount of a PRO1801 polypeptide. The individual in need of immunosuppression may suffer from an autoimmune disease, such as rheumatoid arthritis, myasthenia gravis, insulin-dependent diabetes mellitus, systemic lupus erythematosus, thyroiditis or colitis, or from septic shock, endotoxic shock or any other type of disorder where immunosuppression is desired. The individual may also be one who has received or is to receive a tissue transplant, where the method serves to inhibit rejection of the tissue transplant.

Other embodiments will become evident upon a reading of the present specification.

118. UCP4

A cDNA clone (DNA77568-1626) has been identified, having certain homologies to some known human uncoupling proteins, that encodes a novel polypeptide, designated in the present application as "UCP4."

In one embodiment, the invention provides an isolated nucleic acid molecule comprising DNA encoding a UCP4 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a UCP4 polypeptide having the sequence of amino acid residues from about 1 to about 323, inclusive of FIG. 236 (SEQ ID NO:406), or (b) the complement of the DNA molecule of (a).

In another aspect, the invention concerns an isolated nucleic acid molecule encoding a UCP4 polypeptide comprising DNA hybridizing to the complement of the nucleic acid between about nucleotides 40 and about 1011 inclusive, of FIG. 235 (SEQ ID NO:405). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203134, or (b) the complement of the DNA molecule of (a). In a preferred embodiment, the nucleic acid comprises a DNA encoding the same mature polypeptide encoded by the human protein cDNA in ATCC Deposit No. 203134. In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 323, inclusive of FIG. 236 (SEQ ID NO:406), or the complement of the DNA of (a).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 323, inclusive of FIG. 236 (SEQ ID NO:406), or (b) the complement of the DNA of (a).

Further embodiments of the invention are directed to fragments of the UCP4 coding sequence, which are sufficiently long to be used as hybridization probes. Preferably, such fragments contain at least about 20 to about 80 consecutive bases included in the sequence of FIG. 235 (SEQ ID NO:405). Optionally, such fragments include the N-terminus or the C-terminus of the sequence of FIG. 236 (SEQ ID NO:406).

In another embodiment, the invention provides isolated UCP4 polypeptide encoded by any of the isolated nucleic acid sequences hereinabove defined.

In a specific aspect, the invention provides isolated native sequence UCP4 polypeptide, which in one embodiment, includes an amino acid sequence comprising residues 1 to 323 of FIG. 236 (SEQ ID NO:406).

In another aspect, the invention concerns an isolated UCP4 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 323, inclusive of FIG. 236 (SEQ ID NO:406).

In a further aspect, the invention concerns an isolated UCP4 polypeptide, comprising an amino acid sequence scoring at least about 80% positives, preferably at least about 85% positives, more preferably at least about 90% positives, most preferably at least about 95% positives when compared with the amino acid sequence of residues 1 to 323 of FIG. 236 (SEQ ID NO:406).

In yet another aspect, the invention concerns an isolated UCP4 polypeptide, comprising the sequence of amino acid residues 1 to about 323, inclusive of FIG. 236 (SEQ ID NO:406), or a fragment thereof sufficient to, for instance, provide a binding site for an anti-UCP4 antibody. Preferably, the UCP4 fragment retains at least one biological activity of a native UCP4 polypeptide.

In a still further aspect, the invention provides a polypeptide produced by (i) hybridizing a test DNA molecule under stringent conditions with (a) a DNA molecule encoding a UCP4 polypeptide having the sequence of amino acid residues from about 1 to about 323, inclusive of FIG. 236 (SEQ ID NO:406), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the native UCP4 polypeptide. In a particular embodiment, the agonist or antagonist is an anti-UCP4 antibody.

In a further embodiment, the invention concerns a method of identifying agonists or antagonists of a native UCP4 polypeptide, by contacting the native UCP4 polypeptide with a candidate molecule and monitoring the desired activity. The invention also provides therapeutic methods and diagnostic methods using UCP4.

In a still further embodiment, the invention concerns a composition comprising a UCP4 polypeptide, or an agonist or antagonist as hereinabove defined, in combination with a carrier.

119. PRO193

A cDNA clone (DNA23322-1393) has been identified that encodes a novel multi-transmembrane polypeptide, designated in the present application as "PRO193."

In one embodiment, the invention provides an isolated nucleic acid molecule comprising DNA encoding a PRO193 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO193 polypeptide having the sequence of amino acid residues from about 1 to about 158, inclusive of FIG. 238 (SEQ ID NO:410), or (b) the complement of the DNA molecule of (a).

In another aspect, the invention concerns an isolated nucleic acid molecule encoding a PRO193 polypeptide comprising DNA hybridizing to the complement of the nucleic acid between about residues 138 and about 611, inclusive, of FIG. 237 (SEQ ID NO:409). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No.203400 (DNA23322-1393), or (b) the complement of the DNA molecule of (a). In a preferred embodiment, the nucleic acid comprises a DNA encoding the same mature polypeptide encoded by the human protein cDNA in ATCC Deposit No. 203400 (DNA23322-1393).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 1 to about 158, inclusive of FIG. 238 (SEQ ID NO:410), or the complement of the DNA of (a).

In a further aspect, the invention concerns an isolated nucleic acid molecule produced by hybridizing a test DNA molecule under stringent conditions with (a) a DNA molecule encoding a PRO193 polypeptide having the sequence of amino acid residues from about 1 to about 158, inclusive of FIG. 238 (SEQ ID NO:410), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO193 polypeptide in its soluble form, i.e. transmembrane domain deleted or inactivated variants, or is complementary to such encoding nucleic acid molecule. The transmembrane domain has been tentatively identified as extending from about amino acid positions 23–42, 60–80, 97–117 and 128–148 in the PRO193 amino acid sequence (FIG. 238, SEQ ID NO:410).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 to about 158, inclusive of FIG. 238 (SEQ ID NO:410), or (b) the complement of the DNA of (a).

In another embodiment, the invention provides isolated PRO193 polypeptide encoded by any of the isolated nucleic acid sequences hereinabove defined.

In a specific aspect, the invention provides isolated native sequence PRO193 polypeptide, which in one embodiment, includes an amino acid sequence comprising residues 1 through 158 of FIG. 238 (SEQ ID NO:410).

In another aspect, the invention concerns an isolated PRO193 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 to about 158, inclusive of FIG. 238 (SEQ ID NO:410).

In a further aspect, the invention concerns an isolated PRO193 polypeptide, comprising an amino acid sequence scoring at least about 80% positives, preferably at least about 85% positives, more preferably at least about 90% positives, most preferably at least about 95% positives when compared with the amino acid sequence of residues 1 through 158 of FIG. 238 (SEQ ID NO:410).

In a still further aspect, the invention provides a polypeptide produced by (i) hybridizing a test DNA molecule under stringent conditions with (a) a DNA molecule encoding a PRO193 polypeptide having the sequence of amino acid residues from about 1 to about 158, inclusive of FIG. 238 (SEQ ID NO:410), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of the a native PRO193 polypeptide. In a particular embodiment, the agonist or antagonist is an anti-PRO193 antibody.

In a further embodiment, the invention concerns a method of identifying agonists or antagonists of a native PRO193 polypeptide, by contacting the native PRO193 polypeptide with a candidate molecule and monitoring a biological activity mediated by said polypeptide.

In a still further embodiment, the invention concerns a composition comprising a PRO193 polypeptide, or an agonist or antagonist as hereinabove defined, in combination with a pharmaceutically acceptable carrier.

120. PRO1130

A cDNA clone (DNA59814-1486) has been identified, having homology to nucleic acid encoding the human 2–19 protein that encodes a novel polypeptide, designated in the present application as "PRO1130".

In one embodiment, the invention provides an isolated nucleic acid molecule comprising DNA encoding a PRO1130 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1130 polypeptide having the sequence of amino acid residues from about 1 or about 16 to about 224, inclusive of FIG. 240 (SEQ ID NO:415), or (b) the complement of the DNA molecule of (a).

In another aspect, the invention concerns an isolated nucleic acid molecule encoding a PRO1130 polypeptide comprising DNA hybridizing to the complement of the nucleic acid between about nucleotides 312 or about 357 and about 983, inclusive, of FIG. 239 (SEQ ID NO:414). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203359 (DNA59814-1486) or (b) the complement of the nucleic acid molecule of (a). In a preferred embodiment, the nucleic acid comprises a DNA encoding the same mature polypeptide encoded by the human protein cDNA in ATCC Deposit No. 203359 (DNA59814-1486).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 224, inclusive of FIG. 240 (SEQ ID NO:415), or (b) the complement of the DNA of (a).

In a further aspect, the invention concerns an isolated nucleic acid molecule having at least 10 nucleotides and produced by hybridizing a test DNA molecule under stringent conditions with (a) a DNA molecule encoding a PRO1130 polypeptide having the sequence of amino acid residues from 1 or about 16 to about 224, inclusive of FIG. 240 (SEQ ID NO:415), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1130 polypeptide, with or without the N-terminal signal sequence and/or the initiating methionine, or is complementary to such encoding nucleic acid molecule. The signal peptide has been tentatively identified as extending from about amino acid position 1 to about amino acid position 15 in the sequence of FIG. 240 (SEQ ID NO:415).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 224, inclusive of FIG. 240 (SEQ ID NO:415), or (b) the complement of the DNA of (a).

Another embodiment is directed to fragments of a PRO1130 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 239 (SEQ ID NO:414).

In another embodiment, the invention provides isolated PRO1130 polypeptide encoded by any of the isolated nucleic acid sequences hereinabove identified.

In a specific aspect, the invention provides isolated native sequence PRO1130 polypeptide, which in certain embodiments, includes an amino acid sequence comprising residues 1 or about 16 to about 224 of FIG. 240 (SEQ ID NO:415).

In another aspect, the invention concerns an isolated PRO1130 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 224, inclusive of FIG. 240 (SEQ ID NO:415).

In a further aspect, the invention concerns an isolated PRO1130 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 224, inclusive of FIG. 240 (SEQ ID NO:415).

In yet another aspect, the invention concerns an isolated PRO1130 polypeptide, comprising the sequence of amino acid residues 1 or about 16 to about 224, inclusive of FIG. 240 (SEQ ID NO:415), or a fragment thereof sufficient to provide a binding site for an anti-PRO1130 antibody. Preferably, the PRO1130 fragment retains a qualitative biological activity of a native PRO1130 polypeptide.

In a still further aspect, the invention provides a polypeptide produced by (i) hybridizing a test DNA molecule under stringent conditions with (a) a DNA molecule encoding a PRO1130 polypeptide having the sequence of amino acid residues from about 1 or about 16 to about 224, inclusive of FIG. 240 (SEQ ID NO:415), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1130 polypeptide. In a particular embodiment, the agonist or antagonist is an anti-PRO1130 antibody.

In a further embodiment, the invention concerns a method of identifying agonists or antagonists of a native PRO1130 polypeptide by contacting the native PRO1130 polypeptide with a candidate molecule and monitoring a biological activity mediated by said polypeptide.

In a still further embodiment, the invention concerns a composition comprising a PRO1130 polypeptide, or an agonist or antagonist as hereinabove defined, in combination with a pharmaceutically acceptable carrier.

121. PRO1335

A cDNA clone (DNA62812-1594) has been identified, having homology to nucleic acid encoding carbonic anhydrase that encodes a novel polypeptide, designated in the present application as "PRO1335".

In one embodiment, the invention provides an isolated nucleic acid molecule comprising DNA encoding a PRO1335 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1335 polypeptide having the sequence of amino acid residues from about 1 or about 16 to about 337, inclusive of FIG. 242 (SEQ ID NO:423), or (b) the complement of the DNA molecule of (a).

In another aspect, the invention concerns an isolated nucleic acid molecule encoding a PRO1335 polypeptide comprising DNA hybridizing to the complement of the nucleic acid between about nucleotides 271 or about 316 and about 1281, inclusive, of FIG. 241 (SEQ ID NO:422). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203248 (DNA62812-1594) or (b) the complement of the nucleic acid molecule of (a). In a preferred embodiment, the nucleic acid comprises a DNA encoding the same mature polypeptide encoded by the human protein cDNA in ATCC Deposit No. 203248 (DNA62812-1594).

In still a further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues 1 or about 16 to about 337, inclusive of FIG. 242 (SEQ ID NO:423), or (b) the complement of the DNA of (a).

In a further aspect, the invention concerns an isolated nucleic acid molecule having at least 180 nucleotides and produced by hybridizing a test DNA molecule under stringent conditions with (a) a DNA molecule encoding a PRO1335 polypeptide having the sequence of amino acid residues from 1 or about 16 to about 337, inclusive of FIG. 242 (SEQ ID NO:423), or (b) the complement of the DNA molecule of (a), and, if the DNA molecule has at least about an 80% sequence identity, prefereably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1335 polypeptide, with or without the N-terminal signal sequence and/or the initiating methionine, and its soluble, i.e., transmembrane domain deleted or inactivated variants, or is complementary to such encoding nucleic acid molecule. The signal peptide has been tentatively identified as extending from about amino acid position 1 to about amino acid position 15 in the sequence of FIG. 242 (SEQ ID NO:423). The transmembrane domain has been tentatively identified as extending from about amino acid position 291 to about amino acid position 310 in the PRO1335 amino acid sequence (FIG. 242, SEQ ID NO:423).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 1 or about 16 to about 337, inclusive of FIG. 242 (SEQ ID NO:423), or (b) the complement of the DNA of (a).

Another embodiment is directed to fragments of a PRO1335 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length and most preferably from about 20 to about 40 nucleotides in length and may be derived from the nucleotide sequence shown in FIG. 241 (SEQ ID NO:422).

In another embodiment, the invention provides isolated PRO1335 polypeptide encoded by any of the isolated nucleic acid sequences hereinabove identified.

In a specific aspect, the invention provides isolated native sequence PRO1335 polypeptide, which in certain embodiments, includes an amino acid sequence comprising residues 1 or about 16 to about 337 of FIG. 242 (SEQ ID NO:423).

In another aspect, the invention concerns an isolated PRO1335 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 1 or about 16 to about 337, inclusive of FIG. 242 (SEQ ID NO:423).

In a further aspect, the invention concerns an isolated PRO1335 polypeptide, comprising an amino acid sequence scoring at least about 80% positives, preferably at least about 85% positives, more preferably at least about 90% positives, most preferably at least about 95% positives when compared with the amino acid sequence of residues 1 or about 16 to about 337, inclusive of FIG. 242 (SEQ ID NO:423).

In yet another aspect, the invention concerns an isolated PRO1335 polypeptide, comprising the sequence of amino acid residues 1 or about 16 to about 337, inclusive of FIG. 242 (SEQ ID NO:423), or a fragment thereof sufficient to provide a binding site for an anti-PRO1335 antibody. Preferably, the PRO1335 fragment retains a qualitative biological activity of a native PRO1335 polypeptide.

In a still further aspect, the invention provides a polypeptide produced by (i) hybridizing a test DNA molecule under stringent conditions with (a) a DNA molecule encoding a PRO1335 polypeptide having the sequence of amino acid residues from about 1 or about 16 to about 337, inclusive of FIG. 242 (SEQ ID NO:423), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

In yet another embodiment, the invention concerns agonists and antagonists of a native PRO1335 polypeptide. In a particular embodiment, the agonist or antagonist is an anti-PRO1335 antibody.

In a further embodiment, the invention concerns a method of identifying agonists or antagonists of a native PRO1335 polypeptide by contacting the native PRO1335 polypeptide with a candidate molecule and monitoring a biological activity mediated by said polypeptide.

In a still further embodiment, the invention concerns a composition comprising a PRO1335 polypeptide, or an agonist or antagonist as hereinabove defined, in combination with a pharmaceutically acceptable carrier.

122. PRO1329

A cDNA clone (DNA66660-1585) has been identified that encodes a novel polypeptide designated in the present application as "PRO1329."

In one embodiment, the invention provides an isolated nucleic acid molecule comprising DNA encoding a PRO1329 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1329 polypeptide having the sequence of amino acid residues from 1 or about 17 to about 209, inclusive of FIG. 244 (SEQ ID NO:429), or (b) the complement of the DNA molecule of (a).

In another aspect, the invention concerns an isolated nucleic acid molecule encoding a PRO1329 polypeptide comprising DNA hybridizing to the complement of the nucleic acid between about residues 138 and about 716, inclusive, of FIG. 243 (SEQ ID NO:428). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203279 (DNA66660-1585), or (b) the complement of the DNA molecule of (a). In a preferred embodiment, the nucleic acid comprises a DNA encoding the same mature polypeptide encoded by the human protein cDNA in ATCC Deposit No. 203279 (DNA66660-1585).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 17 to about 209, inclusive of FIG. 244 (SEQ ID NO:429), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1329 polypeptide having the sequence of amino acid residues from about 17 to about 209, inclusive of FIG. 244 (SEQ ID NO:429), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1329 polypeptide, with or without the N-terminal signal sequence and/or the initiating methionine, or is complementary to such encoding nucleic acid molecule. The signal peptide has been tentatively identified as extending from amino acid position 1 through about amino acid position 16 in the sequence of FIG. 244 (SEQ ID NO:429).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 17 to about 209, inclusive of FIG. 244 (SEQ ID NO:429), or (b) the complement of the DNA of (a).

Another embodiment is directed to fragments of a PRO1329 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1329 polypeptide encoded by any of the isolated nucleic acid sequences hereinabove defined.

In a specific aspect, the invention provides isolated native sequence PRO1329 polypeptide, which in one embodiment, includes an amino acid sequence comprising residues 17 to 209 of FIG. 244 (SEQ ID NO:429).

In another aspect, the invention concerns an isolated PRO1329 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 17 to about 209, inclusive of FIG. 244 (SEQ ID NO:429).

In a further aspect, the invention concerns an isolated PRO1329 polypeptide, comprising an amino acid sequence scoring at least about 80% positives, preferably at least about 85% positives, more preferably at least about 90% positives, most preferably at least about 95% positives when compared with the amino acid sequence of residues 17 to 209 of FIG. 244 (SEQ ID NO:429).

In yet another aspect, the invention concerns an isolated PRO1329 polypeptide, comprising the sequence of amino acid residues 17 to about 209, inclusive of FIG. 244 (SEQ ID NO:429), or a fragment thereof sufficient to provide a binding site for an anti-PRO1329 antibody. Preferably, the PRO1329 fragment retains a qualitative biological activity of a native PRO1329 polypeptide.

In a still further aspect, the invention provides a polypeptide produced by (i) hybridizing a test DNA molecule under stringent conditions with (a) a DNA molecule encoding a PRO1329 polypeptide having the sequence of amino acid residues from about 17 to about 209, inclusive of FIG. 244 (SEQ ID NO:429), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

123. PRO1550

A cDNA clone (DNA76393-1664) has been identified that encodes a novel secreted polypeptide and designated in the present application as "PRO1550."

In one embodiment, the invention provides an isolated nucleic acid molecule comprising DNA encoding a PRO1550 polypeptide.

In one aspect, the isolated nucleic acid comprises DNA having at least about 80% sequence identity, preferably at least about 85% sequence identity, more preferably at least about 90% sequence identity, most preferably at least about 95% sequence identity to (a) a DNA molecule encoding a PRO1550 polypeptide having the sequence of amino acid residues from 1 or about 31 to about 243, inclusive of FIG. 246 (SEQ ID NO:431), or (b) the complement of the DNA molecule of (a).

In another aspect, the invention concerns an isolated nucleic acid molecule encoding a PRO1550 polypeptide comprising DNA hybridizing to the complement of the nucleic acid between about residues 228 and about 866, inclusive, of FIG. 245 (SEQ ID NO:430). Preferably, hybridization occurs under stringent hybridization and wash conditions.

In a further aspect, the invention concerns an isolated nucleic acid molecule comprising DNA having at least about 80% sequence identity, preferably at least about 85% sequence identity, more preferably at least about 90% sequence identity, most preferably at least about 95% sequence identity to (a) a DNA molecule encoding the same mature polypeptide encoded by the human protein cDNA in ATCC Deposit No. 203323 (DNA76393-1664), or (b) the complement of the DNA molecule of (a). In a preferred embodiment, the nucleic acid comprises a DNA encoding the same mature polypeptide encoded by the human protein cDNA in ATCC Deposit No. 203323 (DNA76393-1664).

In a still further aspect, the invention concerns an isolated nucleic acid molecule comprising (a) DNA encoding a polypeptide having at least about 80% sequence identity, preferably at least about 85% sequence identity, more preferably at least about 90% sequence identity, most preferably at least about 95% sequence identity to the sequence of amino acid residues from about 31 to about 243, inclusive of FIG. 246 (SEQ ID NO:431), or the complement of the DNA of (a).

In a further aspect, the invention concerns an isolated nucleic acid molecule having at least about 50 nucleotides, and preferably at least about 100 nucleotides and produced by hybridizing a test DNA molecule under stringent conditions with (a) a DNA molecule encoding a PRO1550 polypeptide having the sequence of amino acid residues from about 31 to about 243, inclusive of FIG. 246 (SEQ ID NO:431), or (b) the complement of the DNA molecule of (a), and, if the DNA molecule has at least about an 80% sequence identity, preferably at least about an 85% sequence identity, more preferably at least about a 90% sequence identity, most preferably at least about a 95% sequence identity to (a) or (b), isolating the test DNA molecule.

In a specific aspect, the invention provides an isolated nucleic acid molecule comprising DNA encoding a PRO1550 polypeptide, with or without the N-terminal signal sequence and/or the initiating methionine, or is complementary to such encoding nucleic acid molecule. The signal peptide has been tentatively identified as extending from amino acid position 1 through about amino acid position 30 in the sequence of FIG. 246 (SEQ ID NO:431).

In another aspect, the invention concerns an isolated nucleic acid molecule comprising (a) DNA encoding a polypeptide scoring at least about 80% positives, preferably at least about 85% positives, more preferably at least about 90% positives, most preferably at least about 95% positives when compared with the amino acid sequence of residues 31 to about 243, inclusive of FIG. 246 (SEQ ID NO:431), or (b) the complement of the DNA of (a).

Another embodiment is directed to fragments of a PRO1550 polypeptide coding sequence that may find use as hybridization probes. Such nucleic acid fragments are from about 20 to about 80 nucleotides in length, preferably from about 20 to about 60 nucleotides in length, more preferably from about 20 to about 50 nucleotides in length, and most preferably from about 20 to about 40 nucleotides in length.

In another embodiment, the invention provides isolated PRO1550 polypeptide encoded by any of the isolated nucleic acid sequences hereinabove defined.

In a specific aspect, the invention provides isolated native sequence PRO1550 polypeptide, which in one embodiment, includes an amino acid sequence comprising residues 31 to 243 of FIG. 246 (SEQ ID NO:431).

In another aspect, the invention concerns an isolated PRO1550 polypeptide, comprising an amino acid sequence having at least about 80% sequence identity, preferably at least about 85% sequence identity, more preferably at least about 90% sequence identity, most preferably at least about 95% sequence identity to the sequence of amino acid residues 31 to about 243, inclusive of FIG. 246 (SEQ ID NO:431).

In a further aspect, the invention concerns an isolated PRO1550 polypeptide, comprising an amino acid sequence scoring at least about 80% positives, preferably at least about 85% positives, more preferably at least about 90% positives, most preferably at least about 95% positives when compared with the amino acid sequence of residues 31 to 243 of FIG. 246 (SEQ ID NO:431).

In yet another aspect, the invention concerns an isolated PRO1550 polypeptide, comprising the sequence of amino acid residues 31 to about 243, inclusive of FIG. 246 (SEQ ID NO:431), or a fragment thereof sufficient to provide a binding site for an anti-PRO1550 antibody. Preferably, the PRO1550 fragment retains a qualitative biological activity of a native PRO1550 polypeptide.

In a still further aspect, the invention provides a polypeptide produced by (i) hybridizing a test DNA molecule under stringent conditions with (a) a DNA molecule encoding a PRO1550 polypeptide having the sequence of amino acid residues from about 31 to about 243, inclusive of FIG. 246 (SEQ ID NO:431), or (b) the complement of the DNA molecule of (a), and if the test DNA molecule has at least about an 80% sequence identity, preferably at least about an 85% sequence identity, more preferably at least about a 90% sequence identity, most preferably at least about a 95% sequence identity to (a) or (b), (ii) culturing a host cell comprising the test DNA molecule under conditions suitable for expression of the polypeptide, and (iii) recovering the polypeptide from the cell culture.

124. Additional Embodiments

In other embodiments of the present invention, the invention provides vectors comprising DNA encoding any of the herein described polypeptides. Host cell comprising any such vector are also provided. By way of example, the host cells may be CHO cells, *E. coli*, or yeast. A process for producing any of the herein described polypeptides is further provided and comprises culturing host cells under conditions suitable for expression of the desired polypeptide and recovering the desired polypeptide from the cell culture.

In other embodiments, the invention provides chimeric molecules comprising any of the herein described polypeptides fused to a heterologous polypeptide or amino acid sequence. Example of such chimeric molecules comprise any of the herein described polypeptides fused to an epitope tag sequence or a Fc region of an immunoglobulin.

In another embodiment, the invention provides an antibody which specifically binds to any of the above or below described polypeptides. Optionally, the antibody is a monoclonal antibody, humanized antibody, antibody fragment or single-chain antibody.

In yet other embodiments, the invention provides oligonucleotide probes useful for isolating genomic and cDNA nucleotide sequences, wherein those probes may be derived from any of the above or below described nucleotide sequences.

In other embodiments, the invention provides an isolated nucleic acid molecule comprising a nucleotide sequence that encodes a PRO polypeptide.

In one aspect, the isolated nucleic acid molecule comprises a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule encoding a PRO polypeptide having a full-length amino acid sequence as disclosed herein, an amino acid sequence lacking the signal peptide as disclosed herein or an extracellular domain of a transmembrane protein, with or without the signal peptide, as disclosed herein, or (b) the complement of the DNA molecule of (a).

In other aspects, the isolated nucleic acid molecule comprises a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to (a) a DNA molecule comprising the coding sequence of a full-length PRO polypeptide cDNA as disclosed herein, the coding sequence of a PRO polypeptide lacking the signal peptide as disclosed herein or the coding sequence of an extracellular domain of a transmembrane PRO polypeptide, with or without the signal peptide, as disclosed herein, or (b) the complement of the DNA molecule of (a).

In a further aspect, the invention concerns an isolated nucleic acid molecule comprising a nucleotide sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 98% sequence identity and yet more preferably at least about 99% sequence identity to (a) a DNA molecule that encodes the same mature polypeptide encoded by any of the human protein cDNAs deposited with the ATCC as disclosed herein, or (b) the complement of the DNA molecule of (a).

Another aspect the invention provides an isolated nucleic acid molecule comprising a nucleotide sequence encoding a PRO polypeptide which is either transmembrane domain-deleted or transmembrane domain-inactivated, or is complementary to such encoding nucleotide sequence, wherein the transmembrane domain(s) of such polypeptide are disclosed herein. Therefore, soluble extracellular domains of the herein described PRO polypeptides are contemplated.

Another embodiment is directed to fragments of a PRO polypeptide coding sequence that may find use as, for example, hybridization probes or for encoding fragments of a PRO polypeptide that may optionally encode a polypeptide comprising a binding site for an anti-PRO antibody. Such nucleic acid fragments are usually at least about 20 nucleotides in length, preferably at least about 30 nucleotides in length, more preferably at least about 40 nucleotides in length, yet more preferably at least about 50 nucleotides in length, yet more preferably at least about 60 nucleotides in length, yet more preferably at least about 70 nucleotides in length, yet more preferably at least about 80 nucleotides in length, yet more preferably at least about 90 nucleotides in length, yet more preferably at least about 100 nucleotides in length, yet more preferably at least about 110 nucleotides in length, yet more preferably at least about 120 nucleotides in length, yet more preferably at least about 130 nucleotides in length, yet more preferably at least about 140 nucleotides in length, yet more preferably at least about 150 nucleotides in length, yet more preferably at least about 160 nucleotides in length, yet more preferably at least about 170 nucleotides in length, yet more preferably at least about 180 nucleotides in length, yet more preferably at least about 190 nucleotides in length, yet more preferably at least about 200 nucleotides in length, yet more preferably at least about 250 nucleotides in length, yet more preferably at least about 300 nucleotides in length, yet more preferably at least about 350 nucleotides in length, yet more preferably at least about 400 nucleotides in length, yet more preferably at least about 450 nucleotides in length, yet more preferably at least about 500 nucleotides in length, yet more preferably at least about 600 nucleotides in length, yet more preferably at least about 700 nucleotides in length, yet more preferably at least about 800 nucleotides in length, yet more preferably at least about 900 nucleotides in length and yet more preferably at least about 1000 nucleotides in length, wherein in this context the term "about" means the referenced nucleotide sequence length plus or minus 10% of that referenced length. It is noted that novel fragments of a PRO polypeptide-encoding nucleotide sequence may be determined in a routine manner by aligning the PRO polypeptide-encoding nucleotide sequence with other known nucleotide sequences using any of a number of well known sequence alignment programs and determining which PRO polypeptide-encoding nucleotide sequence fragment(s) are novel. All of such PRO polypeptide-encoding nucleotide sequences are contemplated herein. Also contemplated are the PRO polypeptide fragments encoded by these nucleotide molecule fragments, preferably those PRO polypeptide fragments that comprise a binding site for an anti-PRO antibody.

In another embodiment, the invention provides isolated PRO polypeptide encoded by any of the isolated nucleic acid sequences hereinabove identified.

In a certain aspect, the invention concerns an isolated PRO polypeptide, comprising an amino acid sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to a PRO polypeptide having a full-length amino acid sequence as disclosed herein, an amino acid sequence lacking the signal peptide as disclosed herein or an extracellular domain of a transmembrane protein, with or without the signal peptide, as disclosed herein.

In a further aspect, the invention concerns an isolated PRO polypeptide comprising an amino acid sequence having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to an amino acid sequence encoded by any of the human protein cDNAs deposited with the ATCC as disclosed herein.

In a further aspect, the invention concerns an isolated PRO polypeptide comprising an amino acid sequence scoring at least about 80% positives, preferably at least about 81% positives, more preferably at least about 82% positives, yet more preferably at least about 83% positives, yet more preferably at least about 84% positives, yet more preferably at least about 85% positives, yet more preferably at least about 86% positives, yet more preferably at least about 87% positives, yet more preferably at least about 88% positives, yet more preferably at least about 89% positives, yet more preferably at least about 90% positives, yet more preferably at least about 91% positives, yet more preferably at least about 92% positives, yet more preferably at least about 93% positives, yet more preferably at least about 94% positives, yet more preferably at least about 95% positives, yet more preferably at least about 96% positives, yet more preferably at least about 97% positives, yet more preferably at least about 98% positives and yet more preferably at least about 99% positives when compared with the amino acid sequence of a PRO polypeptide having a full-length amino acid sequence as disclosed herein, an amino acid sequence lacking the signal peptide as disclosed herein or an extracellular domain of a transmembrane protein, with or without the signal peptide, as disclosed herein.

In a specific aspect, the invention provides an isolated PRO polypeptide without the N-terminal signal sequence and/or the initiating methionine and is encoded by a nucleotide sequence that encodes such an amino acid sequence as hereinbefore described. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

Another aspect the invention provides an isolated PRO polypeptide which is either transmembrane domain-deleted or transmembrane domain-inactivated. Processes for producing the same are also herein described, wherein those processes comprise culturing a host cell comprising a vector which comprises the appropriate encoding nucleic acid molecule under conditions suitable for expression of the PRO polypeptide and recovering the PRO polypeptide from the cell culture.

In yet another embodiment, the invention concerns agonists and antagonists of a native PRO polypeptide as defined herein. In a particular embodiment, the agonist or antagonist is an anti-PRO antibody or a small molecule.

In a further embodiment, the invention concerns a method of identifying agonists or antagonists to a PRO polypeptide which comprise contacting the PRO polypeptide with a candidate molecule and monitoring a biological activity mediated by said PRO polypeptide. Preferably, the PRO polypeptide is a native PRO polypeptide.

In a still further embodiment, the invention concerns a composition of matter comprising a PRO polypeptide, or an agonist or antagonist of a PRO polypeptide as herein described, or an anti-PRO antibody, in combination with a carrier. Optionally, the carrier is a pharmaceutically acceptable carrier.

Another embodiment of the present invention is directed to the use of a PRO polypeptide, or an agonist or antagonist thereof as hereinbefore described, or an anti-PRO antibody, for the preparation of a medicament useful in the treatment of a condition which is responsive to the PRO polypeptide, an agonist or antagonist thereof or an anti-PRO antibody.

BRIEF DESCRIPTION OF THE DRAWINGS

FIG. 1 shows a nucleotide sequence (SEQ ID NO:3) of a native sequence PRO1560 (UNQ767) cDNA, wherein SEQ ID NO:3 is a clone designated herein as "DNA19902-1669". The start and stop codons are shown in bold and underlined font.

FIG. 2 shows the amino acid sequence (SEQ ID NO:4) derived from the coding sequence of SEQ ID NO:3 shown in FIG. 1.

FIG. 3 shows a nucleotide sequence (SEQ ID NO:5) of a native sequence PRO444 (UNQ328) cDNA, wherein SEQ ID NO:5 is a clone designated herein as "DNA26846-1397". The start and stop codons are shown in bold and underlined font.

FIG. 4 shows the amino acid sequence (SEQ ID NO:6) derived from the coding sequence of SEQ ID NO:5 shown in FIG. 3.

FIG. 5 shows a nucleotide sequence (SEQ ID NO:7) of a native sequence PRO1018 (UNQ501) cDNA, wherein SEQ ID NO:7 is a clone designated herein as "DNA56107-1415". The start and stop codons are shown in bold and underlined font.

FIG. 6 shows the amino acid sequence (SEQ ID NO:8) derived from the coding sequence of SEQ ID NO:7 shown in FIG. 5.

FIG. 7 shows a nucleotide sequence (SEQ ID NO:9) of native sequence PRO1773 (UNQ835) cDNA, wherein SEQ ID NO:9 is a clone designated herein as "DNA56406-1704". The start and stop codons are shown in bold and underlined font.

FIG. 8 shows the amino acid sequence (SEQ ID NO:10) derived from the coding sequence of SEQ ID NO:9 shown in FIG. 7.

FIG. 9 shows a nucleotide sequence (SEQ ID NO:11) of a native sequence PRO1477 (UNQ747) cDNA, wherein SEQ ID NO:11 is a clone designated herein as "DNA56529-1647". The start and stop codons are shown in bold and underlined font.

FIG. 10 shows the amino acid sequence (SEQ ID NO:12) derived from the coding sequence of SEQ ID NO:11 shown in FIG. 9.

FIG. 11 shows a nucleotide sequence (SEQ ID NO:16) of a native sequence PRO1478 (UNQ748) cDNA, wherein SEQ ID NO:16 is a clone designated herein as "DNA56531-1648". The start and stop codons are shown in bold and underlined font.

FIG. 12 shows the amino acid sequence (SEQ ID NO:17) derived from the coding sequence of SEQ ID NO:16 shown in FIG. 11.

FIG. 13 shows a nucleotide sequence (SEQ ID NO:21) of a native sequence PRO831 (UNQ471) cDNA, wherein SEQ ID NO:21 is a clone designated herein as "DNA56862-1343". The start and stop codons are shown in bold and underlined font.

FIG. 14 shows the amino acid sequence (SEQ ID NO:22) derived from the coding sequence of SEQ ID NO:21 shown in FIG. 13.

FIG. 15 shows a nucleotide sequence (SEQ ID NO:23) of a native sequence PRO1113 (UNQ556) cDNA, wherein SEQ ID NO:23 is a clone designated herein as "DNA57254-1477". The start and stop codons are shown in bold and underlined font.

FIG. 16 shows the amino acid sequence (SEQ ID NO:24) derived from the coding sequence of SEQ ID NO:23 shown in FIG. 15.

FIG. 17 shows a nucleotide sequence (SEQ ID NO:28) of a native sequence PRO1194 (UNQ607) cDNA, wherein SEQ ID NO:28 is a clone designated herein as "DNA57841-1522". The start and stop codons are shown in bold and underlined font.

FIG. 18 shows the amino acid sequence (SEQ ID NO:29) derived from the coding sequence of SEQ ID NO:28 shown in FIG. 17.

FIG. 19 shows a nucleotide sequence (SEQ ID NO:30) of a native sequence PRO1110 (UNQ553) cDNA, wherein SEQ ID NO:30 is a clone designated herein as "DNA58727-1474". The start and stop codons are shown in bold and underlined font.

FIG. 20 shows the amino acid sequence (SEQ ID NO:31) derived from the coding sequence of SEQ ID NO:30 shown in FIG. 19.

FIG. 21 shows a nucleotide sequence (SEQ ID NO:32) of a native sequence PRO1378 (UNQ715) cDNA, wherein SEQ ID NO:32 is a clone designated herein as "DNA58730-1607". The start and stop codons are shown in bold and underlined font.

FIG. 22 shows the amino acid sequence (SEQ ID NO:33) derived from the coding sequence of SEQ ID NO:32 shown in FIG. 21.

FIG. 23 shows a nucleotide sequence (SEQ ID NO:40) of a native sequence PRO1481 (UNQ750) cDNA, wherein SEQ ID NO:40 is a clone designated herein as "DNA58732-1650". The start and stop codons are shown in bold and underlined font.

FIG. 24 shows the amino acid sequence (SEQ ID NO:41) derived from the coding sequence of SEQ ID NO:40 shown in FIG. 23.

FIG. 25 shows a nucleotide sequence (SEQ ID NO:42) of a native sequence PRO1189 (UNQ603) cDNA, wherein SEQ ID NO:42 is a clone designated herein as "DNA58828-1519". The start and stop codons are shown in bold and underlined font.

FIG. 26 shows the amino acid sequence (SEQ ID NO:43) derived from the coding sequence of SEQ ID NO:42 shown in FIG. 25.

FIG. 27 shows a nucleotide sequence (SEQ ID NO:49) of a native sequence PRO1415 (UNQ731) cDNA, wherein SEQ ID NO:49 is a clone designated herein as "DNA58852-1637". The start and stop codons are shown in bold and underlined font.

FIG. 28 shows the amino acid sequence (SEQ ID NO:50) derived from the coding sequence of SEQ ID NO:49 shown in FIG. 27.

FIG. 29 shows a nucleotide sequence (SEQ ID NO:51) of a native sequence PRO1411 (UNQ729) cDNA, wherein SEQ ID NO:51 is a clone designated herein as "DNA59212-1627". The start and stop codons are shown in bold and underlined font.

FIG. 30 shows the amino acid sequence (SEQ ID NO:52) derived from the coding sequence of SEQ ID NO:51 shown in FIG. 29.

FIG. 31 shows a nucleotide sequence (SEQ ID NO:53) of a native sequence PRO1295 (UNQ664) cDNA, wherein SEQ ID NO:53 is a clone designated herein as "DNA59218-1559". The start and stop codons are shown in bold and underlined font.

FIG. 32 shows the amino acid sequence (SEQ ID NO:54) derived from the coding sequence of SEQ ID NO:53 shown in FIG. 31.

FIG. 33 shows a nucleotide sequence (SEQ ID NO:55) of a native sequence PRO1359 (UNQ708) cDNA, wherein SEQ ID NO:55 is a clone designated herein as "DNA59219-1613". The start and stop codons are shown in bold and underlined font.

FIG. 34 shows the amino acid sequence (SEQ ID NO:56) derived from the coding sequence of SEQ ID NO:55 shown in FIG. 33.

FIG. 35 shows a nucleotide sequence (SEQ ID NO:57) of a native sequence PRO1190 (UNQ604) cDNA, wherein SEQ ID NO:57 is a clone designated herein as "DNA59586-1520". The start and stop codons are shown in bold and underlined font.

FIG. 36 shows the amino acid sequence (SEQ ID NO:58) derived from the coding sequence of SEQ ID NO:57 shown in FIG. 35.

FIG. 37 shows a nucleotide sequence (SEQ ID NO:62) of a native sequence PRO1772 (UNQ834) cDNA, wherein SEQ ID NO:62 is a clone designated herein as "DNA59817-1703". The start and stop codons are shown in bold and underlined font.

FIG. 38 shows the amino acid sequence (SEQ ID NO:63) derived from the coding sequence of SEQ ID NO:62 shown in FIG. 37.

FIG. 39 shows a nucleotide sequence (SEQ ID NO:67) of a native sequence PRO1248 (UNQ631) cDNA, wherein SEQ ID NO:67 is a clone designated herein as "DNA60278-1530". The start and stop codons are shown in bold and underlined font.

FIG. 40 shows the amino acid sequence (SEQ ID NO:68) derived from the coding sequence of SEQ ID NO:67 shown in FIG. 39.

FIG. 41 shows a nucleotide sequence (SEQ ID NO:69) of a native sequence PRO1316 (UNQ682) cDNA, wherein SEQ ID NO:69 is a clone designated herein as "DNA60608-1577". The start and stop codons are shown in bold and underlined font.

FIG. 42 shows the amino acid sequence (SEQ ID NO:70) derived from the coding sequence of SEQ ID NO:69 shown in FIG. 41.

FIG. 43 shows a nucleotide sequence (SEQ ID NO:71) of a native sequence PRO1197 (UNQ610) cDNA, wherein SEQ ID NO:71 is a clone designated herein as "DNA60611-1524". The start and stop codons are shown in bold and underlined font.

FIG. 44 shows the amino acid sequence (SEQ ID NO:72) derived from the coding sequence of SEQ ID NO:71 shown in FIG. 43.

FIG. 45 shows a nucleotide sequence (SEQ ID NO:76) of a native sequence PRO1293 (UNQ662) cDNA, wherein SEQ ID NO:76 is a clone designated herein as "DNA60618-1557". The start and stop codons are shown in bold and underlined font.

FIG. 46 shows the amino acid sequence (SEQ ID NO:77) derived from the coding sequence of SEQ ID NO:76 shown in FIG. 45.

FIG. 47 shows a nucleotide sequence (SEQ ID NO:78) of a native sequence PRO1380 (UNQ717) cDNA, wherein SEQ ID NO:78 is a clone designated herein as "DNA60740-1615". The start and stop codons are shown in bold and underlined font.

FIG. 48 shows the amino acid sequence (SEQ ID NO:79) derived from the coding sequence of SEQ ID NO:78 shown in FIG. 47.

FIG. 49 shows a nucleotide sequence (SEQ ID NO:83) of a native sequence PRO1265 (UNQ636) cDNA, wherein SEQ ID NO:83 is a clone designated herein as "DNA60764-1533". The start and stop codons are shown in bold and underlined font.

FIG. 50 shows the amino acid sequence (SEQ ID NO:84) derived from the coding sequence of SEQ ID NO:83 shown in FIG. 49.

FIG. 51 shows a nucleotide sequence (SEQ ID NO:85) of a native sequence PRO1250 (UNQ633) cDNA, wherein SEQ ID NO:85 is a clone designated herein as "DNA60775-1532". The start and stop codons are shown in bold and underlined font.

FIG. 52 shows the amino acid sequence (SEQ ID NO:86) derived from the coding sequence of SEQ ID NO:85 shown in FIG. 51.

FIG. 53 shows a nucleotide sequence (SEQ ID NO:87) of a native sequence PRO1475 (UNQ746) cDNA, wherein SEQ ID NO:87 is a clone designated herein as "DNA61185-1646". The start and stop codons are shown in bold and underlined font.

FIG. 54 shows the amino acid sequence (SEQ ID NO:88) derived from the coding sequence of SEQ ID NO:87 shown in FIG. 53.

FIG. 55 shows a nucleotide sequence (SEQ ID NO:94) of a native sequence PRO1377 (UNQ714) cDNA, wherein SEQ ID NO:94 is a clone designated herein as "DNA61608-1606". The start and stop codons are shown in bold and underlined font.

FIG. 56 shows the amino acid sequence (SEQ ID NO:95) derived from the coding sequence of SEQ ID NO:94 shown in FIG. 55.

FIG. 57 shows a nucleotide sequence (SEQ ID NO:99) of a native sequence PRO1326 (UNQ686) cDNA, wherein SEQ ID NO:99 is a clone designated herein as "DNA62808-1582". The start and stop codons are shown in bold and underlined font.

FIG. 58 shows the amino acid sequence (SEQ ID NO:100) derived from the coding sequence of SEQ ID NO:99 shown in FIG. 57.

FIG. 59 shows a nucleotide sequence (SEQ ID NO:101) of a native sequence PRO1249 (UNQ632) cDNA, wherein SEQ ID NO:101 is a clone designated herein as "DNA62809-1531". The start and stop codons are shown in bold and underlined font.

FIG. 60 shows the amino acid sequence (SEQ ID NO:102) derived from the coding sequence of SEQ ID NO:100 shown in FIG. 59.

FIG. 61 shows a nucleotide sequence (SEQ ID NO:103) of a native sequence PRO1315 (UNQ681) cDNA, wherein SEQ ID NO:103 is a clone designated herein as "DNA62815-1578". The start and stop codons are shown in bold and underlined font.

FIG. 62 shows the amino acid sequence (SEQ ID NO:104) derived from the coding sequence of SEQ ID NO:103 shown in FIG. 61.

FIG. 63 shows a nucleotide sequence (SEQ ID NO:110) of a native sequence PRO1549 (UNQ782) cDNA, wherein SEQ ID NO:110 is a clone designated herein as "DNA62845-1684". The start and stop codons are shown in bold and underlined font.

FIG. 64 shows the amino acid sequence (SEQ ID NO:111) derived from the coding sequence of SEQ ID NO:110 shown in FIG. 63.

FIG. 65 shows a nucleotide sequence (SEQ ID NO:115) of a native sequence PRO1430 (UNQ736) cDNA, wherein SEQ ID NO:115 is a clone designated herein as "DNA64842-1632". The start and stop codons are shown in bold and underlined font.

FIG. 66 shows the amino acid sequence (SEQ ID NO:116) derived from the coding sequence of SEQ ID NO:115 shown in FIG. 65.

FIG. 67 shows a nucleotide sequence (SEQ ID NO:117) of a native sequence PRO1374 (UNQ711) cDNA, wherein SEQ ID NO:117 is a clone designated herein as "DNA64849-1604". The start and stop codons are shown in bold and underlined font.

FIG. 68 shows the amino acid sequence (SEQ ID NO:118) derived from the coding sequence of SEQ ID NO:117 shown in FIG. 67.

FIG. 69 shows a nucleotide sequence (SEQ ID NO:122) of a native sequence PRO1311 (UNQ677) cDNA, wherein SEQ ID NO:122 is a clone designated herein as "DNA64863-1573". The start and stop codons are shown in bold and underlined font.

FIG. 70 shows the amino acid sequence (SEQ ID NO:123) derived from the coding sequence of SEQ ID NO:122 shown in FIG. 69.

FIG. 71 shows a nucleotide sequence (SEQ ID NO:127) of a native sequence PRO1357 (UNQ706) cDNA, wherein SEQ ID NO:127 is a clone designated herein as "DNA64881-1602". The start and stop codons are shown in bold and underlined font.

FIG. 72 shows the amino acid sequence (SEQ ID NO:128) derived from the coding sequence of SEQ ID NO:127 shown in FIG. 71.

FIG. 73 shows a nucleotide sequence (SEQ ID NO:129) of a native sequence PRO1244 (UNQ628) cDNA, wherein SEQ ID NO:129 is a clone designated herein as "DNA64883-1526". The start and stop codons are shown in bold and underlined font.

FIG. 74 shows the amino acid sequence (SEQ ID NO:130) derived from the coding sequence of SEQ ID NO:129 shown in FIG. 73.

FIG. 75 shows a nucleotide sequence (SEQ ID NO:131) of a native sequence PRO1246 (UNQ630) cDNA, wherein SEQ ID NO:131 is a clone designated herein as "DNA64885-1529". The start and stop codons are shown in bold and underlined font.

FIG. 76 shows the amino acid sequence (SEQ ID NO:132) derived from the coding sequence of SEQ ID NO:131 shown in FIG. 75.

FIG. 77 shows a nucleotide sequence (SEQ ID NO:133) of a native sequence PRO1356 (UNQ705) cDNA, wherein SEQ ID NO:133 is a clone designated herein as "DNA64886-1601". The start and stop codons are shown in bold and underlined font.

FIG. 78 shows the amino acid sequence (SEQ ID NO:134) derived from the coding sequence of SEQ ID NO:133 shown in FIG. 77.

FIG. 79 shows a nucleotide sequence (SEQ ID NO:135) of a native sequence PRO1275 (UNQ645) cDNA, wherein SEQ ID NO:135 is a clone designated herein as "DNA64888-1542". The start and stop codons are shown in bold and underlined font.

FIG. 80 shows the amino acid sequence (SEQ ID NO:136) derived from the coding sequence of SEQ ID NO:135 shown in FIG. 79.

FIG. 81 shows a nucleotide sequence (SEQ ID NO:137) of a native sequence PRO1274 (UNQ644) cDNA, wherein SEQ ID NO:137 is a clone designated herein as "DNA64889-1542". The start and stop codons are shown in bold and underlined font.

FIG. 82 shows the amino acid sequence (SEQ ID NO:138) derived from the coding sequence of SEQ ID NO:137 shown in FIG. 81.

FIG. 83 shows a nucleotide sequence (SEQ ID NO:139) of a native sequence PRO1412 (UNQ730) cDNA, wherein SEQ ID NO:139 is a clone designated herein as "DNA64897-1628". The start and stop codons are shown in bold and underlined font.

FIG. 84 shows the amino acid sequence (SEQ ID NO:140) derived from the coding sequence of SEQ ID NO:139 shown in FIG. 83.

FIG. 85 shows a nucleotide sequence (SEQ ID NO:141) of a native sequence PRO1557 (UNQ765) cDNA, wherein SEQ ID NO:141 is a clone designated herein as "DNA64902-1667". The start and stop codons are shown in bold and underlined font.

FIG. 86 shows the amino acid sequence (SEQ ID NO:142) derived from the coding sequence of SEQ ID NO:141 shown in FIG. 85.

FIG. 87 shows a nucleotide sequence (SEQ ID NO:143) of a native sequence PRO1286 (UNQ655) cDNA, wherein SEQ ID NO:143 is a clone designated herein as "DNA64903-1553". The start and stop codons are shown in bold and underlined font.

FIG. 88 shows the amino acid sequence (SEQ ID NO:144) derived from the coding sequence of SEQ ID NO:143 shown in FIG. 87.

FIG. 89 shows a nucleotide sequence (SEQ ID NO:145) of a native sequence PRO1294 (UNQ663) cDNA, wherein SEQ ID NO:145 is a clone designated herein as "DNA64905-1558". The start and stop codons are shown in bold and underlined font.

FIG. 90 shows the amino acid sequence (SEQ ID NO:146) derived from the coding sequence of SEQ ID NO:145 shown in FIG. 89.

FIG. 91 shows a nucleotide sequence (SEQ ID NO:147) of a native sequence PRO1347 (UNQ702) cDNA, wherein SEQ ID NO:147 is a clone designated herein as "DNA64950-1590". The start and stop codons are shown in bold and underlined font.

FIG. 92 shows the amino acid sequence (SEQ ID NO:148) derived from the coding sequence of SEQ ID NO:147 shown in FIG. 91.

FIG. 93 shows a nucleotide sequence (SEQ ID NO:152) of a native sequence PRO1305 (UNQ671) cDNA, wherein SEQ ID NO:152 is a clone designated herein as "DNA64952-1568". The start and stop codons are shown in bold and underlined font.

FIG. 94 shows the amino acid sequence (SEQ ID NO:153) derived from the coding sequence of SEQ ID NO:152 shown in FIG. 93.

FIG. 95 shows a nucleotide sequence (SEQ ID NO:157) of a native sequence PRO1273 (UNQ643) cDNA, wherein SEQ ID NO:157 is a clone designated herein as "DNA65402-1540". The start and stop codons are shown in bold and underlined font.

FIG. 96 shows the amino acid sequence (SEQ ID NO:158) derived from the coding sequence of SEQ ID NO:157 shown in FIG. 95.

FIG. 97 shows a nucleotide sequence (SEQ ID NO:159) of a native sequence PRO1302 (UNQ668) cDNA, wherein SEQ ID NO:159 is a clone designated herein as "DNA65403-1565". The start and stop codons are shown in bold and underlined font.

FIG. 98 shows the amino acid sequence (SEQ ID NO:160) derived from the coding sequence of SEQ ID NO:159 shown in FIG. 97.

FIG. 99 shows a nucleotide sequence (SEQ ID NO:161) of a native sequence PRO1283 (UNQ653) cDNA, wherein SEQ ID NO:161 is a clone designated herein as "DNA65404-1551". The start and stop codons are shown in bold and underlined font.

FIG. 100 shows the amino acid sequence (SEQ ID NO:162) derived from the coding sequence of SEQ ID NO:161 shown in FIG. 99.

FIG. 101 shows a nucleotide sequence (SEQ ID NO:169) of a native sequence PRO1279 (UNQ649) cDNA, wherein SEQ ID NO:169 is a clone designated herein as "DNA65405-1547". The start and stop codons are shown in bold and underlined font.

FIG. 102 shows the amino acid sequence (SEQ ID NO:170) derived from the coding sequence of SEQ ID NO:169 shown in FIG. 101.

FIG. 103 shows a nucleotide sequence (SEQ ID NO:179) of a native sequence PRO1304 (UNQ670) cDNA, wherein SEQ ID NO:179 is a clone designated herein as "DNA65406-1567". The start and stop codons are shown in bold and underlined font.

FIG. 104 shows the amino acid sequence (SEQ ID NO:180) derived from the coding sequence of SEQ ID NO:179 shown in FIG. 103.

FIG. 105 shows a nucleotide sequence (SEQ ID NO:188) of a native sequence PRO1317 (UNQ683) cDNA, wherein SEQ ID NO:188 is a clone designated herein as "DNA65408-1578". The start and stop codons are shown in bold and underlined font.

FIG. 106 shows the amino acid sequence (SEQ ID NO:189) derived from the coding sequence of SEQ ID NO:188 shown in FIG. 105.

FIG. 107 shows a nucleotide sequence (SEQ ID NO:193) of a native sequence PRO1303 (UNQ669) cDNA, wherein SEQ ID NO:193 is a clone designated herein as "DNA65409-1566". The start and stop codons are shown in bold and underlined font.

FIG. 108 shows the amino acid sequence (SEQ ID NO:194) derived from the coding sequence of SEQ ID NO:193 shown in FIG. 107.

FIG. 109 shows a nucleotide sequence (SEQ ID NO:195) of a native sequence PRO1306 (UNQ672) cDNA, wherein SEQ ID NO:195 is a clone designated herein as "DNA65410-1569". The start and stop codons are shown in bold and underlined font.

FIG. 110 shows the amino acid sequence (SEQ ID NO:196) derived from the coding sequence of SEQ ID NO:195 shown in FIG. 109.

FIGS. 111A–B show a nucleotide sequence (SEQ ID NO:197) of a native sequence PRO1336 (UNQ691) cDNA, wherein SEQ ID NO:197 is a clone designated herein as "DNA65423-1595". The start and stop codons are shown in bold and underlined font.

FIG. 112 shows the amino acid sequence (SEQ ID NO:198) derived from the coding sequence of SEQ ID NO:198 shown in FIGS. 111A–B.

FIG. 113 shows a nucleotide sequence (SEQ ID NO:202) of a native sequence PRO1278 (UNQ648) cDNA, wherein SEQ ID NO:202 is a clone designated herein as "DNA66304-1546". The start and stop codons are shown in bold and underlined font.

FIG. 114 shows the amino acid sequence (SEQ ID NO:203) derived from the coding sequence of SEQ ID NO:202 shown in FIG. 113.

FIG. 115 shows a nucleotide sequence (SEQ ID NO:209) of a native sequence PRO1298 (UNQ666) cDNA, wherein SEQ ID NO:209 is a clone designated herein as "DNA66511-1563". The start and stop codons are shown in bold and underlined font.

FIG. 116 shows the amino acid sequence (SEQ ID NO:210) derived from the coding sequence of SEQ ID NO:209 shown in FIG. 115.

FIG. 117 shows a nucleotide sequence (SEQ ID NO:211) of a native sequence PRO1301 (UNQ667) cDNA, wherein SEQ ID NO:211 is a clone designated herein as "DNA66512-1564". The start and stop codons are shown in bold and underlined font.

FIG. 118 shows the amino acid sequence (SEQ ID NO:212) derived from the coding sequence of SEQ ID NO:211 shown in FIG. 117.

FIG. 119 shows a nucleotide sequence (SEQ ID NO:213) of a native sequence PRO1268 (UNQ638) cDNA, wherein SEQ ID NO:213 is a clone designated herein as "DNA66519-1535". The start and stop codons are shown in bold and underlined font.

FIG. 120 shows the amino acid sequence (SEQ ID NO:214) derived from the coding sequence of SEQ ID NO:213 shown in FIG. 119.

FIG. 121 shows a nucleotide sequence (SEQ ID NO:215) of a native sequence PRO1269 (UNQ639) cDNA, wherein SEQ ID NO:215 is a clone designated herein as "DNA66520-1536". The start and stop codons are shown in bold and underlined font.

FIG. 122 shows the amino acid sequence (SEQ ID NO:216) derived from the coding sequence of SEQ ID NO:215 shown in FIG. 121.

FIG. 123 shows a nucleotide sequence (SEQ ID NO:217) of a native sequence PRO1327 (UNQ687) cDNA, wherein SEQ ID NO:217 is a clone designated herein as "DNA66521-1583". The start and stop codons are shown in bold and underlined font.

FIG. 124 shows the amino acid sequence (SEQ ID NO:218) derived from the coding sequence of SEQ ID NO:217 shown in FIG. 123.

FIG. 125 shows a nucleotide sequence (SEQ ID NO:219) of a native sequence PRO1382 (UNQ718) cDNA, wherein SEQ ID NO:219 is a clone designated herein as "DNA66526-1616". The start and stop codons are shown in bold and underlined font.

FIG. 126 shows the amino acid sequence (SEQ ID NO:220) derived from the coding sequence of SEQ ID NO:219 shown in FIG. 125.

FIG. 127 shows a nucleotide sequence (SEQ ID NO:224) of a native sequence PRO1328 (UNQ688) cDNA, wherein SEQ ID NO:224 is a clone designated herein as "DNA66658-1584". The start and stop codons are shown in bold and underlined font.

FIG. 128 shows the amino acid sequence (SEQ ID NO:225) derived from the coding sequence of SEQ ID NO:224 shown in FIG. 127.

FIG. 129 shows a nucleotide sequence (SEQ ID NO:226) of a native sequence PRO1325 (UNQ685) cDNA, wherein SEQ ID NO:226 is a clone designated herein as "DNA66659-1593". The start and stop codons are shown in bold and underlined font.

FIG. 130 shows the amino acid sequence (SEQ ID NO:227) derived from the coding sequence of SEQ ID NO:226 shown in FIG. 129.

FIG. 131 shows a nucleotide sequence (SEQ ID NO:228) of a native sequence PRO1340 (UNQ695) cDNA, wherein SEQ ID NO:228 is a clone designated herein as "DNA66663-1598". The start and stop codons are shown in bold and underlined font.

FIG. 132 shows the amino acid sequence (SEQ ID NO:229) derived from the coding sequence of SEQ ID NO:228 shown in FIG. 131.

FIG. 133 shows a nucleotide sequence (SEQ ID NO:233) of a native sequence PRO1339 (UNQ694) cDNA, wherein SEQ ID NO:233 is a clone designated herein as "DNA66669-1597". The start and stop codons are shown in bold and underlined font.

FIG. 134 shows the amino acid sequence (SEQ ID NO:234) derived from the coding sequence of SEQ ID NO:233 shown in FIG. 133.

FIG. 135 shows a nucleotide sequence (SEQ ID NO:235) of a native sequence PRO1337 (UNQ692) cDNA, wherein SEQ ID NO:235 is a clone designated herein as "DNA66672-1586". The start and stop codons are shown in bold and underlined font.

FIG. 136 shows the amino acid sequence (SEQ ID NO:236) derived from the coding sequence of SEQ ID NO:235 shown in FIG. 135.

FIG. 137 shows a nucleotide sequence (SEQ ID NO:242) of a native sequence PRO1342 (UNQ697) cDNA, wherein SEQ ID NO:242 is a clone designated herein as "DNA66674-1599". The start and stop codons are shown in bold and underlined font.

FIG. 138 shows the amino acid sequence (SEQ ID NO:243) derived from the coding sequence of SEQ ID NO:242 shown in FIG. 137.

FIG. 139 shows a nucleotide sequence (SEQ ID NO:247) of a native sequence PRO1343 (UNQ698) cDNA, wherein SEQ ID NO:247 is a clone designated herein as "DNA66675-1587". The start and stop codons are shown in bold and underlined font.

FIG. 140 shows the amino acid sequence (SEQ ID NO:248) derived from the coding sequence of SEQ ID NO:247 shown in FIG. 139.

FIG. 141 shows a nucleotide sequence (SEQ ID NO:252) of a native sequence PRO1480 (UNQ749) cDNA, wherein SEQ ID NO:252 is a clone designated herein as "DNA67962-1649". The start and stop codons are shown in bold and underlined font.

FIG. 142 shows the amino acid sequence (SEQ ID NO:253) derived from the coding sequence of SEQ ID NO:252 shown in FIG. 141.

FIGS. 143A–B show a nucleotide sequence (SEQ ID NO:259) of a native sequence PRO1487 (UNQ756) cDNA, wherein SEQ ID NO:259 is a clone designated herein as "DNA68836-1656". The start and stop codons are shown in bold and underlined font.

FIG. 144 shows the amino acid sequence (SEQ ID NO:260) derived from the coding sequence of SEQ ID NO:259 shown in FIGS. 143A–B.

FIG. 145 shows a nucleotide sequence (SEQ ID NO:264) of a native sequence PRO1418 (UNQ732) cDNA, wherein SEQ ID NO:264 is a clone designated herein as "DNA68864-1629". The start and stop codons are shown in bold and underlined font.

FIG. 146 shows the amino acid sequence (SEQ ID NO:265) derived from the coding sequence of SEQ ID NO:264 shown in FIG. 145.

FIG. 147 shows a nucleotide sequence (SEQ ID NO:266) of a native sequence PRO1472 (UNQ744) cDNA, wherein SEQ ID NO:266 is a clone designated herein as "DNA68866-1644". The start and stop codons are shown in bold and underlined font.

FIG. 148 shows the amino acid sequence (SEQ ID NO:267) derived from the coding sequence of SEQ ID NO:266 shown in FIG. 147.

FIG. 149 shows a nucleotide sequence (SEQ ID NO:268) of a native sequence PRO1461 (UNQ742) cDNA, wherein SEQ ID NO:268 is a clone designated herein as "DNA68871-1638". The start and stop codons are shown in bold and underlined font.

FIG. 150 shows the amino acid sequence (SEQ ID NO:269) derived from the coding sequence of SEQ ID NO:268 shown in FIG. 149.

FIG. 151 shows a nucleotide sequence (SEQ ID NO:270) of a native sequence PRO1410 (UNQ728) cDNA, wherein SEQ ID NO:270 is a clone designated herein as "DNA68874-1622". The start and stop codons are shown in bold and underlined font.

FIG. 152 shows the amino acid sequence (SEQ ID NO:271) derived from the coding sequence of SEQ ID NO:270 shown in FIG. 151.

FIG. 153 shows a nucleotide sequence (SEQ ID NO:272) of a native sequence PRO1568 (UNQ774) cDNA, wherein SEQ ID NO:272 is a clone designated herein as "DNA68880-1676". The start and stop codons are shown in bold and underlined font.

FIG. 154 shows the amino acid sequence (SEQ ID NO:273) derived from the coding sequence of SEQ ID NO:272 shown in FIG. 153.

FIG. 155 shows a nucleotide sequence (SEQ ID NO:274) of a native sequence PRO1570 (UNQ776) cDNA, wherein SEQ ID NO:274 is a clone designated herein as "DNA68885-1678". The start and stop codons are shown in bold and underlined font.

FIG. 156 shows the amino acid sequence (SEQ ID NO:275) derived from the coding sequence of SEQ ID NO:274 shown in FIG. 155.

FIG. 157 shows a nucleotide sequence (SEQ ID NO:276) of a native sequence PRO1317 (UNQ783) cDNA, wherein SEQ ID NO:276 is a clone designated herein as "DNA71166-1685". The start and stop codons are shown in bold and underlined font.

FIG. 158 shows the amino acid sequence (SEQ ID NO:277) derived from the coding sequence of SEQ ID NO:276 shown in FIG. 157.

FIG. 159 shows a nucleotide sequence (SEQ ID NO:281) of a native sequence PRO1780 (UNQ842) cDNA, wherein SEQ ID NO:281 is a clone designated herein as "DNA71169-1709". The start and stop codons are shown in bold and underlined font.

FIG. 160 shows the amino acid sequence (SEQ ID NO:282) derived from the coding sequence of SEQ ID NO:281 shown in FIG. 159.

FIG. 161 shows a nucleotide sequence (SEQ ID NO:286) of a native sequence PRO1486 (UNQ755) cDNA, wherein SEQ ID NO:286 is a clone designated herein as "DNA71180-1655". The start and stop codons are shown in bold and underlined font.

FIG. 162 shows the amino acid sequence (SEQ ID NO:287) derived from the coding sequence of SEQ ID NO:286 shown in FIG. 161.

FIG. 163 shows a nucleotide sequence (SEQ ID NO:291) of a native sequence PRO1433 (UNQ738) cDNA, wherein SEQ ID NO:291 is a clone designated herein as "DNA71184-1634". The start and stop codons are shown in bold and underlined font.

FIG. 164 shows the amino acid sequence (SEQ ID NO:292) derived from the coding sequence of SEQ ID NO:291 shown in FIG. 163.

FIG. 165 shows a nucleotide sequence (SEQ ID NO:296) of a native sequence PRO1490 (UNQ759) cDNA, wherein SEQ ID NO:296 is a clone designated herein as "DNA71213-1659". The start and stop codons are shown in bold and underlined font.

FIG. 166 shows the amino acid sequence (SEQ ID NO:297) derived from the coding sequence of SEQ ID NO:296 shown in FIG. 165.

FIG. 167 shows a nucleotide sequence (SEQ ID NO:301) of a native sequence PRO1482 (UNQ751) cDNA, wherein SEQ ID NO:301 is a clone designated herein as "DNA71234-1651". The start and stop codons are shown in bold and underlined font.

FIG. 168 shows the amino acid sequence (SEQ ID NO:302) derived from the coding sequence of SEQ ID NO:301 shown in FIG. 167.

FIG. 169 shows a nucleotide sequence (SEQ ID NO:303) of a native sequence PRO1446 (UNQ740) cDNA, wherein SEQ ID NO:303 is a clone designated herein as "DNA71277-1636". The start and stop codons are shown in bold and underlined font.

FIG. 170 shows the amino acid sequence (SEQ ID NO:304) derived from the coding sequence of SEQ ID NO:303 shown in FIG. 169.

FIG. 171 shows a nucleotide sequence (SEQ ID NO:305) of a native sequence PRO1558 (UNQ766) cDNA, wherein SEQ ID NO:305 is a clone designated herein as "DNA71282-1668". The start and stop codons are shown in bold and underlined font.

FIG. 172 shows the amino acid sequence (SEQ ID NO:306) derived from the coding sequence of SEQ ID NO:305 shown in FIG. 171.

FIG. 173 shows a nucleotide sequence (SEQ ID NO:307) of a native sequence PRO1604 (UNQ785) cDNA, wherein SEQ ID NO:307 is a clone designated herein as "DNA71286-1687". The start and stop codons are shown in bold and underlined font.

FIG. 174 shows the amino acid sequence (SEQ ID NO:308) derived from the coding sequence of SEQ ID NO:307 shown in FIG. 173.

FIG. 175 shows a nucleotide sequence (SEQ ID NO:309) of a native sequence PRO1491 (UNQ760) cDNA, wherein SEQ ID NO:309 is a clone designated herein as "DNA71883-1660". The start and stop codons are shown in bold and underlined font.

FIG. 176 shows the amino acid sequence (SEQ ID NO:310) derived from the coding sequence of SEQ ID NO:309 shown in FIG. 175.

FIG. 177 shows a nucleotide sequence (SEQ ID NO:314) of a native sequence PRO1431 (UNQ737) cDNA, wherein SEQ ID NO:314 is a clone designated herein as "DNA73401-1633". The start and stop codons are shown in bold and underlined font.

FIG. 178 shows the amino acid sequence (SEQ ID NO:315) derived from the coding sequence of SEQ ID NO:314 shown in FIG. 177.

FIGS. 179A–B show a nucleotide sequence (SEQ ID NO:316) of a native sequence PRO1563 (UNQ769) cDNA, wherein SEQ ID NO:316 is a clone designated herein as "DNA73492-1671". The start and stop codons are shown in bold and underlined font.

FIG. 180 shows the amino acid sequence (SEQ ID NO:317) derived from the coding sequence of SEQ ID NO:316 shown in FIGS. 179A–B.

FIG. 181 shows a nucleotide sequence (SEQ ID NO:321) of a native sequence PRO1565 (UNQ771) cDNA, wherein SEQ ID NO:321 is a clone designated herein as "DNA73727-1673". The start and stop codons are shown in bold and underlined font.

FIG. 182 shows the amino acid sequence (SEQ ID NO:322) derived from the coding sequence of SEQ ID NO:321 shown in FIG. 181.

FIG. 183 shows a nucleotide sequence (SEQ ID NO:323) of a native sequence PRO1571 (UNQ777) cDNA, wherein SEQ ID NO:323 is a clone designated herein as "DNA73730-1679". The start and stop codons are shown in bold and underlined font.

FIG. 184 shows the amino acid sequence (SEQ ID NO:324) derived from the coding sequence of SEQ ID NO:323 shown in FIG. 183.

FIG. 185 shows a nucleotide sequence (SEQ ID NO:325) of a native sequence PRO1572 (UNQ778) cDNA, wherein SEQ ID NO:325 is a clone designated herein as "DNA73734-1680". The start and stop codons are shown in bold and underlined font.

FIG. 186 shows the amino acid sequence (SEQ ID NO:326) derived from the coding sequence of SEQ ID NO:325 shown in FIG. 185.

FIG. 187 shows a nucleotide sequence (SEQ ID NO:327) of a native sequence PRO1573 (UNQ779) cDNA, wherein SEQ ID NO:327 is a clone designated herein as "DNA73735-1681". The start and stop codons are shown in bold and underlined font.

FIG. 188 shows the amino acid sequence (SEQ ID NO:328) derived from the coding sequence of SEQ ID NO:327 shown in FIG. 187.

FIG. 189 shows a nucleotide sequence (SEQ ID NO:329) of a native sequence PRO1488 (UNQ757) cDNA, wherein SEQ ID NO:329 is a clone designated herein as "DNA73736-1657". The start and stop codons are shown in bold and underlined font.

FIG. 190 shows the amino acid sequence (SEQ ID NO:330) derived from the coding sequence of SEQ ID NO:329 shown in FIG. 189.

FIG. 191 shows a nucleotide sequence (SEQ ID NO:331) of a native sequence PRO1489 (UNQ758) cDNA, wherein SEQ ID NO:331 is a clone designated herein as "DNA73737-1658". The start and stop codons are shown in bold and underlined font.

FIG. 192 shows the amino acid sequence (SEQ ID NO:332) derived from the coding sequence of SEQ ID NO:331 shown in FIG. 191.

FIG. 193 shows a nucleotide sequence (SEQ ID NO:333) of a native sequence PRO1474 (UNQ745) cDNA, wherein SEQ ID NO:333 is a clone designated herein as "DNA73739-1645". The start and stop codons are shown in bold and underlined font.

FIG. 194 shows the amino acid sequence (SEQ ID NO:334) derived from the coding sequence of SEQ ID NO:333 shown in FIG. 193.

FIG. 195 shows a nucleotide sequence (SEQ ID NO:335) of a native sequence PRO1508 (UNQ761) cDNA, wherein SEQ ID NO:335 is a clone designated herein as "DNA73742-1662". The start and stop codons are shown in bold and underlined font.

FIG. 196 shows the amino acid sequence (SEQ ID NO:336) derived from the coding sequence of SEQ ID NO:335 shown in FIG. 195.

FIG. 197 shows a nucleotide sequence (SEQ ID NO:337) of a native sequence PRO1555 (UNQ763) cDNA, wherein SEQ ID NO:337 is a clone designated herein as "DNA73744-1665". The start and stop codons are shown in bold and underlined font.

FIG. 198 shows the amino acid sequence (SEQ ID NO:338) derived from the coding sequence of SEQ ID NO:337 shown in FIG. 197.

FIG. 199 shows a nucleotide sequence (SEQ ID NO:339) of a native sequence PRO1485 (UNQ754) cDNA, wherein SEQ ID NO:339 is a clone designated herein as "DNA73746-1654". The start and stop codons are shown in bold and underlined font.

FIG. 200 shows the amino acid sequence (SEQ ID NO:340) derived from the coding sequence of SEQ ID NO:339 shown in FIG. 199.

FIG. 201 shows a nucleotide sequence (SEQ ID NO:346) of a native sequence PRO1564 (UNQ770) cDNA, wherein SEQ ID NO:346 is a clone designated herein as "DNA73760-1672". The start and stop codons are shown in bold and underlined font.

FIG. 202 shows the amino acid sequence (SEQ ID NO:347) derived from the coding sequence of SEQ ID NO:346 shown in FIG. 201.

FIG. 203 shows a nucleotide sequence (SEQ ID NO:351) of a native sequence PRO1755 (UNQ828) cDNA, wherein SEQ ID NO:351 is a clone designated herein as "DNA76396-1698". The start and stop codons are shown in bold and underlined font.

FIG. 204 shows the amino acid sequence (SEQ ID NO:352) derived from the coding sequence of SEQ ID NO:351 shown in FIG. 203.

FIG. 205 shows a nucleotide sequence (SEQ ID NO:353) of a native sequence PRO1757 (UNQ830) cDNA, wherein SEQ ID NO:353 is a clone designated herein as "DNA76398-1699". The start and stop codons are shown in bold and underlined font.

FIG. 206 shows the amino acid sequence (SEQ ID NO:354) derived from the coding sequence of SEQ ID NO:353 shown in FIG. 205.

FIG. 207 shows a nucleotide sequence (SEQ ID NO:355) of a native sequence PRO1758 (UNQ831) cDNA, wherein SEQ ID NO:355 is a clone designated herein as "DNA76399-1700". The start and stop codons are shown in bold and underlined font.

FIG. 208 shows the amino acid sequence (SEQ ID NO:356) derived from the coding sequence of SEQ ID NO:355 shown in FIG. 207.

FIG. 209 shows a nucleotide sequence (SEQ ID NO:357) of a native sequence PRO1575 (UNQ781) cDNA, wherein SEQ ID NO:357 is a clone designated herein as "DNA76401-1683". The start and stop codons are shown in bold and underlined font.

FIG. 210 shows the amino acid sequence (SEQ ID NO:358) derived from the coding sequence of SEQ ID NO:357 shown in FIG. 209.

FIG. 211 shows a nucleotide sequence (SEQ ID NO:363) of a native sequence PRO1787 (UNQ849) cDNA, wherein SEQ ID NO:363 is a clone designated herein as "DNA76510-2504". The start and stop codons are shown in bold and underlined font.

FIG. 212 shows the amino acid sequence (SEQ ID NO:364) derived from the coding sequence of SEQ ID NO:363 shown in FIG. 211.

FIG. 213 shows a nucleotide sequence (SEQ ID NO:365) of a native sequence PRO1781 (UNQ843) cDNA, wherein SEQ ID NO:365 is a clone designated herein as "DNA76522-2500". The start and stop codons are shown in bold and underlined font.

FIG. 214 shows the amino acid sequence (SEQ ID NO:366) derived from the coding sequence of SEQ ID NO:365 shown in FIG. 213.

FIG. 215 shows a nucleotide sequence (SEQ ID NO:371) of a native sequence PRO1556 (UNQ764) cDNA, wherein SEQ ID NO:371 is a clone designated herein as "DNA76529-1666". The start and stop codons are shown in bold and underlined font.

FIG. 216 shows the amino acid sequence (SEQ ID NO:372) derived from the coding sequence of SEQ ID NO:371 shown in FIG. 215.

FIG. 217 shows a nucleotide sequence (SEQ ID NO:373) of a native sequence PRO1759 (UNQ832) cDNA, wherein SEQ ID NO:373 is a clone designated herein as "DNA76531-1701". The start and stop codons are shown in bold and underlined font.

FIG. 218 shows the amino acid sequence (SEQ ID NO:374) derived from the coding sequence of SEQ ID NO:373 shown in FIG. 217.

FIG. 219 shows a nucleotide sequence (SEQ ID NO:375) of a native sequence PRO1760 (UNQ833) cDNA, wherein SEQ ID NO:375 is a clone designated herein as "DNA76532-1702". The start and stop codons are shown in bold and underlined font.

FIG. 220 shows the amino acid sequence (SEQ ID NO:376) derived from the coding sequence of SEQ ID NO:375 shown in FIG. 219.

FIG. 221 shows a nucleotide sequence (SEQ ID NO:377) of a native sequence PRO1561 (UNQ768) cDNA, wherein SEQ ID NO:377 is a clone designated herein as "DNA76538-1670". The start and stop codons are shown in bold and underlined font.

FIG. 222 shows the amino acid sequence (SEQ ID NO:378) derived from the coding sequence of SEQ ID NO:377 shown in FIG. 221.

FIG. 223 shows a nucleotide sequence (SEQ ID NO:382) of a native sequence PRO1567 (UNQ773) cDNA, wherein SEQ ID NO:382 is a clone designated herein as "DNA76541-1675". The start and stop codons are shown in bold and underlined font.

FIG. 224 shows the amino acid sequence (SEQ ID NO:383) derived from the coding sequence of SEQ ID NO:382 shown in FIG. 223.

FIG. 225 shows a nucleotide sequence (SEQ ID NO:384) of a native sequence PRO1693 (UNQ803) cDNA, wherein SEQ ID NO:384 is a clone designated herein as "DNA77301-1693". The start and stop codons are shown in bold and underlined font.

FIG. 226 shows the amino acid sequence (SEQ ID NO:385) derived from the coding sequence of SEQ ID NO:384 shown in FIG. 225.

FIG. 227 shows a nucleotide sequence (SEQ ID NO:389) of a native sequence PRO1784 (UNQ846) cDNA, wherein SEQ ID NO:389 is a clone designated herein as "DNA77303-2502". The start and stop codons are shown in bold and underlined font.

FIG. 228 shows the amino acid sequence (SEQ ID NO:390) derived from the coding sequence of SEQ ID NO:389 shown in FIG. 227.

FIG. 229 shows a nucleotide sequence (SEQ ID NO:394) of a native sequence PRO1605 (UNQ786) cDNA, wherein SEQ ID NO:394 is a clone designated herein as "DNA77648-1688". The start and stop codons are shown in bold and underlined font.

FIG. 230 shows the amino acid sequence (SEQ ID NO:395) derived from the coding sequence of SEQ ID NO:394 shown in FIG. 229.

FIG. 231 shows a nucleotide sequence (SEQ ID NO:396) of a native sequence PRO1788 (UNQ850) cDNA, wherein SEQ ID NO:396 is a clone designated herein as "DNA77652-2505". The start and stop codons are shown in bold and underlined font.

FIG. 232 shows the amino acid sequence (SEQ ID NO:397) derived from the coding sequence of SEQ ID NO:396 shown in FIG. 231.

FIG. 233 shows a nucleotide sequence (SEQ ID NO:401) of a native sequence PRO1801 (UNQ852) cDNA, wherein SEQ ID NO:401 is a clone designated herein as "DNA83500-2506". The start and stop codons are shown in bold and underlined font.

FIG. 234 shows the amino acid sequence (SEQ ID NO:402) derived from the coding sequence of SEQ ID NO:401 shown in FIG. 233.

FIG. 235 shows a nucleotide sequence (SEQ ID NO:405) of a native sequence UCP4 cDNA, wherein SEQ ID NO:405 is a clone designated herein as "DNA77568-1626". The start and stop codons are shown in bold and underlined font.

FIG. 236 shows the amino acid sequence (SEQ ID NO:406) derived from the coding sequence of SEQ ID NO:405 shown in FIG. 235.

FIG. 237 shows a nucleotide sequence (SEQ ID NO:409) of a native sequence PRO193 cDNA, wherein SEQ ID NO:409 is a clone designated herein as "DNA23322-1393". The start and stop codons are shown in bold and underlined font.

FIG. 238 shows the amino acid sequence (SEQ ID NO:410) derived from the coding sequence of SEQ ID NO:409 shown in FIG. 237.

FIG. 239 shows a nucleotide sequence (SEQ ID NO:414) of a native sequence PRO1130 cDNA, wherein SEQ ID NO:414 is a clone designated herein as "DNA59814-1486". The start and stop codons are shown in bold and underlined font.

FIG. 240 shows the amino acid sequence (SEQ ID NO:415) derived from the coding sequence of SEQ ID NO:414 shown in FIG. 239.

FIG. 241 shows a nucleotide sequence (SEQ ID NO:422) of a native sequence PRO1335 cDNA, wherein SEQ ID NO:422 is a clone designated herein as "DNA62812-1594". The start and stop codons are shown in bold and underlined font.

FIG. 242 shows the amino acid sequence (SEQ ID NO:423) derived from the coding sequence of SEQ ID NO:422 shown in FIG. 241.

FIG. 243 shows a nucleotide sequence (SEQ ID NO:428) of a native sequence PRO1329 cDNA, wherein SEQ ID NO:428 is a clone designated herein as "DNA66660-1585". The start and stop codons are shown in bold and underlined font.

FIG. 244 shows the amino acid sequence (SEQ ID NO:429) derived from the coding sequence of SEQ ID NO:428 shown in FIG. 243.

FIG. 245 shows a nucleotide sequence (SEQ ID NO:430) of a native sequence PRO1550 cDNA, wherein SEQ ID NO:430 is a clone designated herein as "DNA76393-1664". The start and stop codons are shown in bold and underlined font.

FIG. 246 shows the amino acid sequence (SEQ ID NO:431) derived from the coding sequence of SEQ ID NO:430 shown in FIG. 245.

DETAILED DESCRIPTION OF THE PREFERRED EMBODIMENTS

I. Definitions

The terms "PRO polypeptide" and "PRO" as used herein and when immediately followed by a numerical designation refer to various polypeptides, wherein the complete designation (i.e., PRO/number) refers to specific polypeptide sequences as described herein. The terms "PRO/number polypeptide" and "PRO/number" wherein the term "number" is provided as an actual numerical designation as used herein encompass native sequence polypeptides and polypeptide variants (which are further defined herein). The PRO polypeptides described herein may be isolated from a variety of sources, such as from human tissue types or from another source, or prepared by recombinant or synthetic methods.

A "native sequence PRO polypeptide" comprises a polypeptide having the same amino acid sequence as the corresponding PRO polypeptide derived from nature. Such native sequence PRO polypeptides can be isolated from nature or can be produced by recombinant or synthetic means. The term "native sequence PRO polypeptide" specifically encompasses naturally-occurring truncated or secreted forms of the specific PRO polypeptide (e.g., an extracellular domain sequence), naturally-occurring variant forms (e.g., alternatively spliced forms) and naturally-occurring allelic variants of the polypeptide. In various embodiments of the invention, the native sequence PRO polypeptides disclosed herein are mature or full-length native sequence polypeptides comprising the full-length amino acids sequences shown in the accompanying figures. Start and stop codons are shown in bold font and underlined in the figures. However, while the PRO polypeptide disclosed in the accompanying figures are shown to begin with methionine residues designated herein as amino acid position 1 in the figures, it is conceivable and possible that other methionine residues located either upstream or downstream from the amino acid position 1 in the figures may be employed as the starting amino acid residue for the PRO polypeptides.

The PRO polypeptide "extracellular domain" or "ECD" refers to a form of the PRO polypeptide which is essentially free of the transmembrane and cytoplasmic domains. Ordinarily, a PRO polypeptide ECD will have less than 1% of such transmembrane and/or cytoplasmic domains and preferably, will have less than 0.5% of such domains. It will be understood that any transmembrane domains identified for the PRO polypeptides of the present invention are identified pursuant to criteria routinely employed in the art for identifying that type of hydrophobic domain. The exact boundaries of a transmembrane domain may vary but most likely by no more than about 5 amino acids at either end of the domain as initially identified herein. Optionally, therefore, an extracellular domain of a PRO polypeptide may contain from about 5 or fewer amino acids on either side of the transmembrane domain/extracellular domain boundary as identified in the Examples or specification and such polypeptides, with or without the associated signal peptide, and nucleic acid encoding them, are comtemplated by the present invention.

The approximate location of the "signal peptides" of the various PRO polypeptides disclosed herein are shown in the present specification and/or the accompanying figures. It is noted, however, that the C-terminal boundary of a signal peptide may vary, but most likely by no more than about 5 amino acids on either side of the signal peptide C-terminal boundary as initially identified herein, wherein the C-terminal boundary of the signal peptide may be identified pursuant to criteria routinely employed in the art for identifying that type of amino acid sequence element (e.g., Nielsen et al., *Prot. Eng.* 10:1–6 (1997) and von Heinje et al., *Nucl. Acids. Res.* 14:4683–4690 (1986)). Moreover, it is also recognized that, in some cases, cleavage of a signal sequence from a secreted polypeptide is not entirely uniform, resulting in more than one secreted species. These mature polypeptides, where the signal peptide is cleaved within no more than about 5 amino acids on either side of the C-terminal boundary of the signal peptide as identified herein, and the polynucleotides encoding them, are contemplated by the present invention.

"PRO polypeptide variant" means an active PRO polypeptide as defined above or below having at least about 80% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Such PRO polypeptide variants include, for instance, PRO polypeptides wherein one or more amino acid residues are added, or deleted, at the N- or C-terminus of the full-length native amino acid sequence. Ordinarily, a PRO polypeptide variant will have at least about 80% amino acid sequence identity, preferably at least about 81% amino acid sequence identity, more preferably at least about 82% amino acid sequence identity, more preferably at least about 83% amino acid sequence identity, more preferably at least about 84% amino acid sequence identity, more preferably at least about 85% amino acid sequence identity, more preferably at least about 86% amino acid sequence identity, more preferably at least about 87% amino acid sequence identity, more preferably at least about 88% amino acid sequence identity, more preferably at least about 89% amino acid sequence identity, more preferably at least about 90% amino acid sequence identity, more preferably at least about 91% amino acid sequence identity, more preferably at least about 92% amino acid sequence identity, more preferably at least about 93% amino acid sequence identity, more preferably at least about 94% amino acid sequence identity, more preferably at least about 95% amino acid sequence identity, more preferably at least about 96% amino acid sequence identity, more preferably at least about 97% amino acid sequence identity, more preferably at least about 98% amino acid sequence identity and most preferably at least about 99% amino acid sequence identity with a full-length native sequence PRO polypeptide sequence as disclosed herein, a PRO polypeptide sequence lacking the signal peptide as disclosed herein, an extracellular domain of a PRO polypeptide, with or without the signal peptide, as disclosed herein or any other specifically defined fragment of a full-length PRO polypeptide sequence as disclosed herein. Ordinarily, PRO variant polypeptides are at least about 10 amino acids in length, often at least about 20 amino acids in length, more often at least about 30 amino acids in length, more often at least about 40 amino acids in length, more often at least about 50 amino acids in length, more often at least about 60 amino acids in length, more often at least about 70 amino acids in length, more often at least about 80 amino acids in length, more often at least about 90 amino acids in length, more often at least about 100 amino acids in length, more often at least about 150 amino acids in length, more often at least about 200 amino acids in length, more often at least about 300 amino acids in length, or more.

"Percent (%) amino acid sequence identity" with respect to the PRO polypeptide sequences identified herein is defined as the percentage of amino acid residues in a candidate sequence that are identical with the amino acid residues in the specific PRO polypeptide sequence, after aligning the sequences and introducing gaps, if necessary, to achieve the maximum percent sequence id entity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. For purposes herein, however, % amino acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.OD. All sequence comparison parameters are set by the ALIGN-2 program and do not vary.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. As examples of % amino acid sequence identity calculations using this method, Tables 2 and 3 demonstrate how to calculate the % amino acid sequence identity of the amino acid sequence designated "Comparison Protein" to the amino acid sequence designated "PRO", wherein "PRO" represents the amino acid sequence of a hypothetical PRO polypeptide of interest, "Comparison Protein" represents the amino acid sequence of a polypeptide against which the "PRO" polypeptide of interest is being compared, and "X," "Y" and "Z" each represent different hypothetical amino acid residues.

Unless specifically stated otherwise, all % amino acid sequence identity values used herein are obtained as described in the immediately preceding paragraph using the ALIGN-2 computer program. However, % amino acid sequence identity values may also be obtained as described below by using the WU-BLAST-2 computer program (Altschul et al., *Methods in Enzymology* 266:460–480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % amino acid sequence identity value is determined by dividing (a) the number of matching identical amino acid residues between the amino acid sequence of the PRO polypeptide of interest having a sequence derived from the native PRO polypeptide and the comparison amino acid sequence of interest (i.e., the sequence against which the PRO polypeptide of interest is being compared which may be a PRO variant polypeptide) as determined by WU-BLAST-2 by (b) the total number of amino acid residues of the PRO polypeptide of interest. For example, in the statement "a polypeptide comprising an the amino acid sequence A which has or having at least 80% amino acid sequence identity to the amino acid sequence B", the amino acid sequence A is the comparison amino acid sequence of interest and the amino acid sequence B is the amino acid sequence of the PRO polypeptide of interest.

Percent amino acid sequence identity may also be determined using the sequence comparison program NCBI-BLAST2 (Altschul et al., *Nucleic Acids Res.* 25:3389–3402 (1997)). NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

"PRO variant polynucleotide" or "PRO variant nucleic acid sequence" means a nucleic acid molecule which encodes an active PRO polypeptide as defined below and which has at least about 80% nucleic acid sequence identity with a nucleotide acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal peptide, as disclosed herein or any other fragment of a full-length PRO polypeptide sequence as disclosed herein. Ordinarily, a PRO variant polynucleotide will have at least about 80% nucleic acid sequence identity, more preferably at least about 81% nucleic acid sequence identity, more preferably at least about 82% nucleic acid sequence identity, more preferably at least about 83% nucleic acid sequence identity, more preferably at least about 84% nucleic acid sequence identity, more preferably at least about 85% nucleic acid sequence identity, more preferably at least about 86% nucleic acid sequence identity, more preferably at least about 87% nucleic acid sequence identity, more preferably at least about 88% nucleic acid sequence identity, more preferably at least about 89% nucleic acid sequence identity, more preferably at least about 90% nucleic acid sequence identity, more preferably at least about 91% nucleic acid sequence identity, more preferably at least about 92% nucleic acid sequence identity, more preferably at least about 93% nucleic acid sequence identity, more preferably at least about 94% nucleic acid sequence identity, more preferably at least about 95% nucleic acid sequence identity, more preferably at least about 96% nucleic acid sequence identity, more preferably at least about 97% nucleic acid sequence identity, more preferably at least about 98% nucleic acid sequence identity and yet more preferably at least about 99% nucleic acid sequence identity with a nucleic acid sequence encoding a full-length native sequence PRO polypeptide sequence as disclosed herein, a full-length native sequence PRO polypeptide sequence lacking the signal peptide as disclosed herein, an extracellular domain of a PRO polypeptide, with or without the signal sequence, as disclosed herein or any other fragment of a full-length PRO polypeptide sequence as disclosed herein. Variants do not encompass the native nucleotide sequence.

Ordinarily, PRO variant polynucleotides are at least about 30 nucleotides in length, often at least about 60 nucleotides in length, more often at least about 90 nucleotides in length, more often at least about 120 nucleotides in length, more often at least about 150 nucleotides in length, more often at least about 180 nucleotides in length, more often at least about 210 nucleotides in length, more often at least about 240 nucleotides in length, more often at least about 270 nucleotides in length, more often at least about 300 nucleotides in length, more often at least about 450 nucleotides in length, more often at least about 600 nucleotides in length, more often at least about 900 nucleotides in length, or more.

"Percent (%) nucleic acid sequence identity" with respect to PRO-encoding nucleic acid sequences identified herein is defined as the percentage of nucleotides in a candidate sequence that are identical with the nucleotides in the PRO nucleic acid sequence of interest, after aligning the sequences and introducing gaps, if necessary, to achieve the maximum percent sequence identity. Alignment for purposes of determining percent nucleic acid sequence identity can be achieved in various ways that are within the skill in the art, for instance, using publicly available computer software such as BLAST, BLAST-2, ALIGN or Megalign (DNASTAR) software. For purposes herein, however, % nucleic acid sequence identity values are generated using the sequence comparison computer program ALIGN-2, wherein the complete source code for the ALIGN-2 program is provided in Table 1 below. The ALIGN-2 sequence comparison computer program was authored by Genentech, Inc. and the source code shown in Table 1 below has been filed with user documentation in the U.S. Copyright Office, Washington D.C., 20559, where it is registered under U.S. Copyright Registration No. TXU510087. The ALIGN-2 program is publicly available through Genentech, Inc., South San Francisco, Calif. or may be compiled from the source code provided in Table 1 below. The ALIGN-2 program should be compiled for use on a UNIX operating system, preferably digital UNIX V4.0D. All sequence comparison parameters are set by the ALIGN-2 program and do not vary.

In situations where ALIGN-2 is employed for nucleic acid sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction $W/Z$ where W is the number of nucleotides scored as identical matches by the sequence alignment program ALIGN-2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C. As examples of % nucleic acid sequence identity calculations, Tables 4 and 5, demonstrate how to calculate the % nucleic acid sequence identity of the nucleic acid sequence designated "Comparison DNA" to the nucleic acid sequence designated "PRO-DNA", wherein "PRO-DNA" represents a hypothetical PRO-encoding nucleic acid sequence of interest, "Comparison DNA" represents the nucleotide sequence of a nucleic acid molecule against which the "PRO-DNA" nucleic acid molecule of interest is being compared, and "N", "L" and "V" each represent different hypothetical nucleotides.

Unless specifically stated otherwise, all % nucleic acid sequence identity values used herein are obtained as described in the immediately preceding paragraph using the ALIGN-2 computer program. However, % nucleic acid sequence identity values may also be obtained as described below by using the WU-BLAST-2 computer program (Altschul et al., *Methods in Enzymology* 266:460–480 (1996)). Most of the WU-BLAST-2 search parameters are set to the default values. Those not set to default values, i.e., the adjustable parameters, are set with the following values: overlap span=1, overlap fraction=0.125, word threshold (T)=11, and scoring matrix=BLOSUM62. When WU-BLAST-2 is employed, a % nucleic acid sequence identity value is determined by dividing (a) the number of matching identical nucleotides between the nucleic acid sequence of the PRO polypeptide-encoding nucleic acid molecule of interest having a sequence derived from the native sequence PRO polypeptide-encoding nucleic acid and the comparison nucleic acid molecule of interest (i.e., the sequence against which the PRO polypeptide-encoding nucleic acid molecule of interest is being compared which may be a variant PRO polynucleotide) as determined by WU-BLAST-2 by (b) the total number of nucleotides of the PRO polypeptide-encoding nucleic acid molecule of interest. For example, in the statement "an isolated nucleic acid molecule comprising a nucleic acid sequence A which has or having at least 80% nucleic acid sequence identity to the nucleic acid sequence B", the nucleic acid sequence A is the comparison nucleic acid molecule of interest and the nucleic acid sequence B is the nucleic acid sequence of the PRO polypeptide-encoding nucleic acid molecule of interest.

Percent nucleic acid sequence identity may also be determined using the sequence comparison program NCBI-BLAST2 (Altschul et al., *Nucleic Acids Res.* 25:3389–3402

(1997)). NCBI-BLAST2 uses several search parameters, wherein all of those search parameters are set to default values including, for example, unmask=yes, strand=all, expected occurrences=10, minimum low complexity length=15/5, multi-pass e-value=0.01, constant for multi-pass=25, dropoff for final gapped alignment=25 and scoring matrix=BLOSUM62.

In situations where NCBI-BLAST2 is employed for sequence comparisons, the % nucleic acid sequence identity of a given nucleic acid sequence C to, with, or against a given nucleic acid sequence D (which can alternatively be phrased as a given nucleic acid sequence C that has or comprises a certain % nucleic acid sequence identity to, with, or against a given nucleic acid sequence D) is calculated as follows:

100 times the fraction W/z where W is the number of nucleotides scored as identical matches by the sequence alignment program NCBI-BLAST2 in that program's alignment of C and D, and where Z is the total number of nucleotides in D. It will be appreciated that where the length of nucleic acid sequence C is not equal to the length of nucleic acid sequence D, the % nucleic acid sequence identity of C to D will not equal the % nucleic acid sequence identity of D to C.

In other embodiments, PRO variant polynucleotides are nucleic acid molecules that encode an active PRO polypeptide and which are capable of hybridizing, preferably under stringent hybridization and wash conditions, to nucleotide sequences encoding a full-length PRO polypeptide as disclosed herein. PRO variant polypeptides may be those that are encoded by a PRO variant polynucleotide.

The term "positives", in the context of sequence comparison performed as described above, includes residues in the sequences compared that are not identical but have similar properties (e.g. as a result of conservative substitutions, see Table 6 below). For purposes herein, the % value of positives is determined by dividing (a) the number of amino acid residues scoring a positive value between the PRO polypeptide amino acid sequence of interest having a sequence derived from the native PRO polypeptide sequence and the comparison amino acid sequence of interest (i.e., the amino acid sequence against which the PRO polypeptide sequence is being compared) as determined in the BLOSUM62 matrix of WU-BLAST-2 by (b) the total number of amino acid residues of the PRO polypeptide of interest.

Unless specifically stated otherwise, the % value of positives is calculated as described in the immediately preceding paragraph. However, in the context of the amino acid sequence identity comparisons performed as described for ALIGN-2 and NCBI-BLAST-2 above, includes amino acid residues in the sequences compared that are not only identical, but also those that have similar properties. Amino acid residues that score a positive value to an amino acid residue of interest are those that are either identical to the amino acid residue of interest or are a preferred substitution (as defined in Table 6 below) of the amino acid residue of interest.

For amino acid sequence comparisons using ALIGN-2 or NCBI-BLAST2, the % value of positives of a given amino acid sequence A to, with, or against a given amino acid sequence B (which can alternatively be phrased as a given amino acid sequence A that has or comprises a certain % positives to, with, or against a given amino acid sequence B) is calculated as follows:

100 times the fraction X/y where X is the number of amino acid residues scoring a positive value as defined above by the sequence alignment program ALIGN-2 or NCBI-BLAST2 in that program's alignment of A and B, and where Y is the total number of amino acid residues in B. It will be appreciated that where the length of amino acid sequence A is not equal to the length of amino acid sequence B, the % positives of A to B will not equal the % positives of B to A.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. In preferred embodiments, the polypeptide will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Isolated polypeptide includes polypeptide in situ within recombinant cells, since at least one component of the PRO polypeptide natural environment will not be present. Ordinarily, however, isolated polypeptide will be prepared by at least one purification step.

An "isolated" PRO polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal location different from that of natural cells.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "antibody" is used in the broadest sense and specifically covers, for example, single anti-PRO monoclonal antibodies (including agonist, antagonist, and neutralizing antibodies), anti-PRO antibody compositions with polyepitopic specificity, single chain anti-PRO antibodies, and fragments of anti-PRO antibodies (see below). The term "monoclonal antibody" as used herein refers to an antibody obtained from a population of substantially homogeneous antibodies, i.e., the individual antibodies comprising the population are identical except for possible naturally-occurring mutations that may be present in minor amounts.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, may be identified by those that: (1) employ low ionic strength and high temperature for washing, for example 0.015 M sodium chloride/0.0015 M sodium citrate/ 0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and %SDS) less stringent that those described above. An example of moderately stringent conditions is overnight incubation at 37° C. in a solution comprising: 20% formamide, 5×SSC (150 mM NaCl, 15 mM trisodium citrate), 50 MM sodium phosphate (pH 7.6), 5× Denhardt's solution, 10% dextran sulfate, and 20 mg/ml denatured sheared salmon sperm DNA, followed by washing the filters in 1×SSC at about 37–50° C. The skilled artisan will recognize how to adjust the temperature, ionic strength, etc. as necessary to accommodate factors such as probe length and the like.

The term "epitope tagged" when used herein refers to a chimeric polypeptide comprising a PRO polypeptide fused to a "tag polypeptide". The tag polypeptide has enough residues to provide an epitope against which an antibody can be made, yet is short enough such that it does not interfere with activity of the polypeptide to which it is fused. The tag polypeptide preferably also is fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

As used herein, the term "immunoadhesin" designates antibody-like molecules which combine the binding specificity of a heterologous protein (an "adhesin") with the effector functions of immunoglobulin constant domains. Structurally, the immunoadhesins comprise a fusion of an amino acid sequence with the desired binding specificity which is other than the antigen recognition and binding site of an antibody (i.e., is "heterologous"), and an immunoglobulin constant domain sequence. The adhesin part of an immunoadhesin molecule typically is a contiguous amino acid sequence comprising at least the binding site of a receptor or a ligand. The immunoglobulin constant domain sequence in the immunoadhesin may be obtained from any immunoglobulin, such as IgG-1, IgG-2, IgG-3, or IgG4 subtypes, IgA (including IgA-1 and IgA-2), IgE, IgD or IgM.

"Active" or "activity" for the purposes herein refers to form(s) of a PRO polypeptide which retain a biological and/or an immunological activity of native or naturally-occurring PRO, wherein "biological" activity refers to a biological function (either inhibitory or stimulatory) caused by a native or naturally-occurring PRO other than the ability to induce the production of an antibody against an antigenic epitope possessed by a native or naturally-occurring PRO and an "immunological" activity refers to the ability to induce the production of an antibody against an antigenic epitope possessed by a native or naturally-occurring PRO.

The term "antagonist" is used in the broadest sense, and includes any molecule that partially or fully blocks, inhibits, or neutralizes a biological activity of a native PRO polypeptide disclosed herein. In a similar manner, the term "agonist" is used in the broadest sense and includes any molecule that mimics a biological activity of a native PRO polypeptide disclosed herein. Suitable agonist or antagonist molecules specifically include agonist or antagonist antibodies or antibody fragments, fragments or amino acid sequence variants of native PRO polypeptides, peptides, antisense oligonucleotides, small organic molecules, etc. Methods for identifying agonists or antagonists of a PRO polypeptide may comprise contacting a PRO polypeptide with a candidate agonist or antagonist molecule and measuring a detectable change in one or more biological activities normally associated with the PRO polypeptide.

"Treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented.

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

"Mammal" for purposes of treatment refers to any animal classified as a mammal, including humans, domestic and farm animals, and zoo, sports, or pet animals, such as dogs, cats, cattle, horses, sheep, pigs, goats, rabbits, etc. Preferably, the mammal is human.

Administration "in combination with" one or more further therapeutic agents includes simultaneous (concurrent) and consecutive administration in any order.

"Carriers" as used herein include pharmaceutically acceptable carriers, excipients, or stabilizers which are non-toxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN, polyethylene glycol (PEG), and PLURONICS™.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., *Protein Eng.* 8(10): 1057–1062 [1995]); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')$_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab fragments differ from Fab' fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv, see Pluckthun in *The Pharmacology of Monoclonal Antibodies*, vol. 113, Rosenburg and Moore eds., Springer-Verlag, New York, pp. 269–315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA*, 90:6444–6448 (1993).

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The word "label" when used herein refers to a detectable compound or composition which is conjugated directly or indirectly to the antibody so as to generate a "labeled" antibody. The label may be detectable by itself (e.g. radioisotope labels or fluorescent labels) or, in the case of an enzymatic label, may catalyze chemical alteration of a substrate compound or composition which is detectable.

By "solid phase" is meant a non-aqueous matrix to which the antibody of the present invention can adhere. Examples of solid phases encompassed herein include those formed partially or entirely of glass (e.g., controlled pore glass), polysaccharides (e.g., agarose), polyacrylamides, polystyrene, polyvinyl alcohol and silicones. In certain embodiments, depending on the context, the solid phase can comprise the well of an assay plate; in others it is a purification column (e.g., an affinity chromatography column). This term also includes a discontinuous solid phase of discrete particles, such as those described in U.S. Pat. No. 4,275,149.

A "liposome" is a small vesicle composed of various types of lipids, phospholipids and/or surfactant which is useful for delivery of a drug (such as a PRO polypeptide or antibody thereto) to a mammal. The components of the liposome are commonly arranged in a bilayer formation, similar to the lipid arrangement of biological membranes.

A "small molecule" is defined herein to have a molecular weight below about 500 Daltons.

TABLE 1

```
/*
 *
 * C—C increased from 12 to 15
 * Z is average of EQ
 * B is average of ND
 * match with stop is _M; stop—stop = 0; J (joker) match = 0
 */
#define   _M    -8        /* value of a match with a stop */
int       _day[26][26] = {
/*       A  B  C  D  E  F  G  H  I  J  K  L  M  N  O  P  Q  R  S  T  U  V  W  X  Y  Z */
/* A */ { 2, 0,-2, 0, 0,-4, 1,-1,-1, 0,-1,-2,-1, 0,_M, 1, 0,-2, 1, 1, 0, 0,-6, 0,-3, 0},
/* B */ { 0, 3,-4, 3, 2,-5, 0, 1,-2, 0, 0,-3,-2, 2,_M,-1, 1, 0, 0, 0, 0,-2,-5, 0,-3, 1},
/* C */ {-2,-4,15,-5,-5,-4,-3,-3,-2, 0,-5,-6,-5,-4,_M,-3,-5,-4, 0,-2, 0,-2,-8, 0, 0,-5},
/* D */ { 0, 3,-5, 4, 3,-6, 1, 1,-2, 0, 0,-4,-3, 2,_M,-1, 2,-1, 0, 0, 0,-2,-7, 0,-4, 2},
/* E */ { 0, 2,-5, 3, 4,-5, 0, 1,-2, 0, 0,-3,-2, 1,_M,-1, 2,-1, 0, 0, 0,-2,-7, 0,-4, 3},
/* F */ {-4,-5,-4,-6,-5, 9,-5,-2, 1, 0,-5, 2, 0,-4,_M,-5,-5,-4,-3,-3, 0,-1, 0, 0, 7,-5},
/* G */ { 1, 0,-3, 1, 0,-5, 5,-2,-3, 0,-2,-4,-3, 0,_M,-1,-1,-3, 1, 0, 0,-1,-7, 0,-5, 0},
/* H */ {-1, 1,-3, 1, 1,-2,-2, 6,-2, 0, 0,-2,-2, 2,_M, 0, 3, 2,-1,-1, 0,-2,-3, 0, 0, 2},
/* I */ {-1,-2,-2,-2,-2, 1,-3,-2, 5, 0,-2, 2, 2,-2,_M,-2,-2,-2,-1, 0, 0, 4,-5, 0,-1,-2},
/* J */ { 0, 0, 0, 0, 0, 0, 0, 0, 0, 0, 0, 0, 0, 0,_M, 0, 0, 0, 0, 0, 0, 0, 0, 0, 0, 0},
/* K */ {-1, 0,-5, 0, 0,-5,-2, 0,-2, 0, 5,-3, 0, 1,_M,-1, 1, 3, 0, 0, 0,-2,-3, 0,-4, 0},
/* L */ {-2,-3,-6,-4,-3, 2,-4,-2, 2, 0,-3, 6, 4,-3,_M,-3,-2,-3,-3 ,-1, 0, 2,-2, 0,-1,-2}
/* M */ {-1,-2,-5,-3,-2, 0,-3,-2, 2, 0, 0, 4, 6,-2,_M,-2,-1, 0,-2,-1, 0, 2,-4, 0,-2,-1},
/* N */ { 0, 2,-4, 2, 1,-4, 0, 2,-2, 0, 1,-3,-2, 2,_M,-1, 1, 0, 1, 0, 0,-2,-4, 0,-2, 1},
/* O */ {_M,_M,_M,_M,_M,_M,_M,_M,_M,_M,_M,_M,_M,_M, 0,_M,_M,_M,_M,_M,_M,_M,_M,_M,_M,_M},
/* P */ { 1,-1,-3,-1,-1,-5,-1, 0,-2, 0,-1,-3,-2,-1,_M, 6, 0, 0, 1, 0, 0,-1,-6, 0,-5, 0},
/* Q */ { 0, 1,-5, 2, 2,-5,-1, 3,-2, 0, 1,-2,-1, 1,_M, 0, 4, 1,-1,-1, 0,-2,-5, 0,-4, 3},
/* R */ {-2, 0,-4,-1,-1,-4,-3, 2,-2, 0, 3,-3, 0, 0,_M, 0, 1, 6, 0,-1, 0,-2, 2, 0,-4, 0},
/* S */ { 1, 0, 0, 0, 0,-3, 1,-1,-1, 0, 0,-3,-2, 1,_M, 1,-1, 0, 2, 1, 0,-1,-2, 0,-3, 0},
/* T */ { 1, 0,-2, 0, 0,-3, 0,-1, 0, 0, 0,-1,-1, 0,_M, 0,-1,-1, 1, 3, 0, 0,-5, 0,-3, 0},
/* U */ { 0, 0, 0, 0, 0, 0, 0, 0, 0, 0, 0, 0, 0, 0,_M, 0, 0, 0, 0, 0, 0, 0, 0, 0, 0, 0},
/* V */ { 0,-2,-2,-2,-2,-1,-1,-2, 4, 0,-2, 2, 2,-2,_M,-1,-2,-2,-1, 0, 0, 4,-6, 0,-2,-2},
/* W */ {-6,-5,-8,-7,-7, 0,-7,-3,-5, 0,-3,-2,-4,-4,_M,-6,-5, 2,-2,-5, 0,-6,17, 0, 0,-6},
/* X */ { 0, 0, 0, 0, 0, 0, 0, 0, 0, 0, 0, 0,_M, 0, 0, 0, 0, 0, 0, 0, 0, 0, 0, 0, 0, 0},
/* Y */ {-3,-3, 0,-4,-4, 7,-5, 0,-1, 0,-4,-1,-2,-2,_M,-5,-4,-4,-3,-3, 0,-2, 0, 0,10,-4},
/* Z */ { 0, 1,-5, 2, 3,-5, 0, 2,-2, 0, 0,-2,-1, 1,_M, 0, 3, 0, 0, 0, 0,-2,-6, 0,-4, 4}
};
/*
 */
#include <stdio.h>
#include <ctype.h>
#define MAXJMP      16       /* max jumps in a diag */
#define MAXGAP      24       /* don't continue to penalize gaps larger than this */
#define JMPS        1024     /* max jmps in an path */
#define MX          4        /* save if there's at least MX-1 bases since last jmp */
#define DMAT        3        /* value of matching bases */
#define DMIS        0        /* penalty for mismatched bases */
#define DINS0       8        /* penalty for a gap */
#define DINS1       1        /* penalty per base */
#define PINS0       8        /* penalty for a gap */
#define PINS1       4        /* penalty per residue */
struct jmp {
    short          n[MAXJMP];      /* size of jmp (neg for dely) */
    unsigned short x[MAXJMP];      /* base no. of jmp in seq x */
                                   /* limits seq to 2^16 -1 */
};
struct diag {
    int            score;          /* score at last jmp */
    long           offset;         /* offset of prev block */
    short          ijmp;           /* current jmp index */
    struct jmp     jp;             /* list of jmps */
};
struct path {
    int            spc;            /* number of leading spaces */
    short          n[JMPS];        /* size of jmp (gap) */
    int            x[JMPS];        /* loc of jmp (last elem before gap) */
};
char       *ofile;             /* output file name */
char       *namex[2];          /* seq names: getseqs() */
char       *prog;              /* prog name for err msgs */
char       *seqx[2];           /* seqs: getseqs() */
int        dmax;               /* best diag: nw() */
int        dmax0;              /* final diag */
int        dna;                /* set if dna: main() */
int        endgaps;            /* set if penalizing end gaps */
int        gapx, gapy;         /* total gaps in seqs */
int        len0, len1;         /* seq lens */
int        ngapx, ngapy;       /* total size of gaps */
int        smax;               /* max score: nw() */
```

TABLE 1-continued

```
int         *xbm;                /* bitmap for matching */
long        offset;              /* current offset in jmp file */
struct diag *dx;                 /* holds diagonals */
struct path pp[2];               /* holds path for seqs */
char        *calloc(), *malloc(), *index(), *strcpy();
char        *getseq(), *g_calloc();
/* Needleman-Wunsch alignment program
*
* usage: progs file1 file2
*     where file1 and file2 are two dna or two protein sequences.
*     The sequences can be in upper- or lower-case an may contain ambiguity
*     Any lines beginning with ';', '>' or '<' are ignored
*     Max file length is 65535 (limited by unsigned short x in the jmp struct)
*     A sequence with ⅓ or more of its elements ACGTU is assumed to be DNA
*     Output is in the file "align.out"
*
* The program may create a tmp file in /tmp to hold info about traceback.
* Original version developed under BSD 4.3 on a vax 8650
*/
#include "nw.h"
#include "day.h"
static __dbval[26] = {
    1,14,2,13,0,0,4,11,0,0,12,0,3,15,0,0,0,5,6,8,8,7,9,0,10,0
};
static __pbval[26] = {
    1, 2|(1<<('D'-'A'))|(1<<('N'-'A')), 4, 8, 16, 32, 64,
    128, 256, 0xFFFFFFF, 1<<10, 1<<11, 1<<12, 1<<13, 1<<14,
    1<<15, 1<<16, 1< <17, 1<<18, 1<<19, 1<<20, 1<<21, 1<<22,
    1<<23, 1<<24, 1<<25|(1<<('E'-'A'))|(1<<('Q'-'A'))
};
main(ac, av)                                                                        main
    int   ac;
    char  *av[];
{
    prog = av[0];
    if(ac != 3) {
        fprintf(stderr, "usage: %s file1 file2\n", prog);
        fprintf(stderr, "where file1 and file2 are two dna or two protein sequences.\n");
        fprintf(stderr, "The sequences can be in upper- or lower-case\n");
        fprintf(stderr, "Any lines beginning with ';' or '<' are ignored\n");
        fprintf(stderr, "Output is in the file \"align.out\"\n");
        exit(1);
    }
    namex[0] = av[1];
    namex[1] = av[2];
    seqx[0] = getseq(namex[0], &len0);
    seqx[1] = getseq(namex[1], &len1);
    xbm = (dna)? __dbval : __pbval;
    endgaps = 0;          /* 1 to penalize endgaps */
    ofile = "align.out";  /* output file */
    nw();                 /* fill in the matrix, get the possible jmps */
    readjmps();           /* get the actual jmps */
    print();              /* print stats, alignment */
    cleanup(0);           /* unlink any tmp files */
}
/* do the alignment, return best score: main()
* dna: values in Fitch and Smith, PNAS, 80, 1382–1386, 1983
* pro: PAM 250 values
* When scores are equal, we prefer mismatches to any gap, prefer
* a new gap to extending an ongoing gap, and prefer a gap in seqx
* to a gap in seq y.
*/
nw()                                                                                nw
{
    char     *px, *py;        /* seqs and ptrs */
    int      *ndely, *dely;   /* keep track of dely */
    int      ndelx, delx;     /* keep track of delx */
    int      *tmp;            /* for swapping row0, row1 */
    int      mis;             /* score for each type */
    int      ins0, ins1;      /* insertion penalties */
    register id;              /* diagonal index */
    register ij;              /* jmp index */
    register *col0, *col1;    /* score for curr, last row */
    register xx, yy;          /* index into seqs */
    dx = (struct diag *)g_calloc("to get diags", len0+len1+1, sizeof(struct diag));
    ndely = (int *)g_calloc("to get ndely", len1+1, sizeof(int));
    dely = (int *)g_calloc("to get dely", len1+1, sizeof(int));
    col0 = (int *)g_calloc("to get col0", len1+1, sizeof(int));
    col1 = (int *)g_calloc("to get col1", len1+1, sizeof(int));
```

TABLE 1-continued

```
ins0 = (dna)? DINS0 : PINS0;
ins1 = (dna)? DINS1 : PlNS1;
smax = -10000;
if (endgaps) {
    for (col0[0] = dely[0] = -ins0, yy = 1; yy <= len1; yy+ +) {
        col0[yy] = dely[yy] = col0[yy-1] - ins1;
        ndely[yy] = yy;
    }
    col0[0] = 0;       /* Waterman Bull Math Biol 84 */
}
else
    for (yy = 1; yy <= len1; yy+ +)
        dely[yy] = -ins0;
/* fill in match matrix
*/
for (px = seqx[0], xx = 1; xx <= len0; px+ +, xx+ +) {
    /* initialize first entry in col
    */
    if (endgaps) {
        if (xx = = 1)
            col1[0] = delx = -(ins0+ins1);
        else
            col1[0] = delx = col0[0]-ins1;
        ndelx = xx;
    }
    else {
        col1[0] = 0;
        delx = -ins0;
        ndelx = 0;
    }
    for (py = seqx[1], yy = 1; yy <= len1; py+ +, yy+ +) {
        mis = col0[yy-1];
        if (dna)
            mis += (xbm[*px-'A']&xbm[*py-'A'])? DMAT : DMIS;
        else
            mis += __day[*px-'A'][*py-'A'];
        /* update penalty for del in x seq;
         * favor new del over ongong del
         * ignore MAXGAP if weighting endgaps
         */
        if (endgaps || ndely[yy] < MAXGAP) {
            if (col0[yy] - ins0 >= dely[yy]) {
                dely[yy] = col0[yy] - (ins0+ins1);
                ndely[yy] = 1;
            } else {
                dely[yy] -= ins1;
                ndely[yy]+ +;
            }
        } else {
            if (col0[yy] - (ins0+ins1) >= dely[yy]) {
                dely[yy] = col0[yy] - (ins0+ins1);
                ndely[yy] = 1;
            } else
                ndely[yy]+ +;
        }
        /* update penalty for del in y seq;
         * favor new del over ongong del
         */
        if (endgaps || ndelx < MAXGAP) {
            if(col1[yy-1] - ins0 >= delx) {
                delx = col1[yy-1] - (ins0+ins1);
                ndelx = 1;
            } else {
                delx -= ins1;
                ndelx+ +;
            }
        } else {
            if (col1[yy-1] - (ins0+ins1) >= delx) {
                delx = col1[yy-1] - (ins0+ins1);
                ndelx = 1;
            } else
                ndelx++;
        }
        /* pick the maximum score; we're favoring
         * mis over any del and delx over dely
         */
        id = xx - yy + len1 - 1;
        if (mis >= delx && mis >= dely[yy])
            col1[yy] = mis;
```

TABLE 1-continued

```
            else if (delx >= dely[yy]) {
                col1[yy] = delx;
                ij = dx[id].ijmp;
                if (dx[id].jp.n[0] && (!dna || (ndelx >= MAXJMP
                    && xx > dx[id].jp.x[ij]+MX) || mis > dx[id].score+DINS0)) {
                    dx[id].ijmp++;
                    if (+ +ij >= MAXJMP) {
                        writejmps(id);
                        ij = dx[id].ijmp = 0;
                        dx[id].offset = offset;
                        offset += sizeof(struct jmp) + sizeof(offset);
                    }
                }
                dx[id].jp.n[ij] = ndelx;
                dx[id].jp.x[ij] = xx;
                dx[id].score = delx;
            }
            else {
                col1[yy] = dely[yy];
                ij = dx[id].ijmp;
        if (dx[id].jp.n[0] && (!dna || (ndely[yy] >= MAXJMP
                    && xx > dx[id].jp.x[ij]+MX) || mis > dx[id].score+DINS0)) {
                    dx[id].ijmp+ +;
                    if (+ +ij >= MAXJMP) {
                        writejmps(id);
                        ij = dx[id].ijmp = 0;
                        dx[id].offset = offset;
                        offset += sizeof(struct jmp) + sizeof(offset);
                    }
                }
                dx[id].jp.n[ij] =- ndely[yy];
                dx[id].jp.x[ij] = xx;
                dx[id].score = dely[yy];
            }
            if (xx = = len0 && yy < len1) {
                /* last col
                 */
                if (endgaps)
                    col1[yy] -= ins0+ins1*(len1-yy);
                if(col1[yy] > smax) {
                    smax = col1[yy];
                    dmax = id;
                }
            }
        }
        if (endgaps && xx < len0)
            col1[yy-1] -= ins0+ins1*(len0-xx);
        if (col1[yy-1] > smax) {
            smax = col1[yy-1];
            dmax = id;
        }
        tmp = col0; col0 = col1; col1 = tmp;
    }
    (void) free((char *)ndely);
    (void) free((char *)dely);
    (void) free((char *)col0);
    (void) free((char *)col1);
}
/*
*
* print() -- only routine visible outside this module
*
* static:
* getmat() -- trace back best path, count matches: print()
* pr_align() -- print alignment of described in array p[]: print()
* dumpblock() -- dump a block of lines with numbers, stars: pr_align()
* nums() -- put out a number line: dumpblock()
* putline() -- put out a line (name, [num], seq, [num]): dumpblock()
* stars() - -put a line of stars: dumpblock()
* stripname() -- strip any path and prefix from a seqname
*/
#include "nw.h"
#define SPC         3
#define P_LINE      256     /* maximum output line */
#define P_SPC       3       /* space between name or num and seq */
extern      _day[26][26];
int         olen;           /* set output line length */
FILE        *fx;            /* output file */
```

TABLE 1-continued

```
print()                                                                                                        print
{
    int     lx, ly, firstgap, lastgap;      /* overlap */
    if ((fx = fopen(ofile, "w")) = = 0) {
            fprintf(stderr, "%s: can't write %s\n", prog, ofile);
            cleanup(1);
    }
    fprintf(fx, "<first sequence: %s (length = %d)\n", namex[0], len0);
    fprintf(fx, "<second sequence: %s (length = %d)\n", namex[1], len1);
    olen = 60;
    lx = len0;
    ly = len1;
    firstgap = lastgap = 0;
    if (dmax < len1 - 1) {                  /* leading gap in x */
        pp[0].spc = firstgap = len1 - dmax - 1;
        ly -= pp[0].spc;
    }
    else if (dmax > len1 - 1) {             /* leading gap in y */
        pp[1].spc = firstgap = dmax - (len1 - 1);
        lx -= pp[1].spc;
    }
    if (dmax0 < len0 - 1) {                 /* trailing gap in x */
        lastgap = len0 - dmax0 -1;
        lx -= lastgap;
    }
    else if (dmax0 > len0 - 1) {            /* trailing gap in y */
        lastgap = dmax0 - (len0 - 1);
        ly -= lastgap;
    }
    getmat(lx, ly, firstgap, lastgap);
    pr_align();
}
/*
* trace back the best path, count matches
*/
static
getmat(lx, ly, firstgap, lastgap)                                                                              getmat
    int     lx, ly;                 /* "core" (minus endgaps) */
    int     firstgap, lastgap;      /* leading trailing overlap */
{
    int             nm, i0, i1, siz0, siz1;
    char            outx[32];
    double          pct;
    register        n0, n1;
    register char   *p0, *p1;
    /* get total matches, score
    */
    i0 = i1 = siz0 = siz1 = 0;
    p0 = seqx[0] + pp[1].spc;
    p1 = seqx[1] + pp[0].spc;
    n0 = pp[1].spc + 1;
    n1 = pp[0].spc + 1;
    nm = 0;
    while ( *p0 && *p1 ) {
        if (siz0) {
            p1+ +;
            n1+ +;
            siz0- -;
        }
        else if (siz1) {
            p0++;
            n0++;
            siz1- -;
        }
        else {
            if (xbm[*p0-'A']&xbm[*p1-'A'])
                nm++;
            if (n0+ + = = pp[0].x[i0])
                siz0 = pp[0].n[i0+ +];
            if (n1+ + = = pp[1].x[i1])
                siz1 = pp[1].n[i1+ +];
            p0++;
            p1+ +;
        }
    }
    /* pct homology:
    * if penalizing endgaps, base is the shorter seq
    * else, knock off overhangs and take shorter core
    */
```

TABLE 1-continued

```
        if (endgaps)
            lx = (len0 < len1)? len0 : len1;
        else
            lx = (lx < ly)? lx : ly;
        pct = 100.*(double)nm/(double)lx;
        fprintf(fx, "\n");
        fprintf(fx, "<%d match%s in an overlap of %d: %.2f percent similarity\n",
            nm, (nm = = 1)? "" : "es", lx, pct);
        fprintf(fx, "<gaps in first sequence: %d", gapx);
        if (gapx) {
            (void) sprintf(outx, "(%d %s%s)",
                ngapx, (dna)? "base": "residue", (ngapx = = 1)? "":"s");
            fprintf(fx, "%s", outx);
        fprintf(fx, ", gaps in second sequence: %d", gapy);
        if (gapy) {
            (void) sprintf(outx, "(%d %s%s)",
                ngapy, (dna)? "base":"residue", (ngapy = = 1)? "":"s");
            fprintf(fx, "%s", outx);
        }
        if (dna)
            fprintf(fx,
            "\n<score: %d (match = %d, mismatch = %d, gap penalty = %d + %d per base)\n",
                smax, DMAT, DMIS, DINS0, DINS1);
        else
            fprintf(fx,
            "\n<score: %d (Dayhoff PAM 250 matrix, gap penalty = %d + %d per residue)\n",
                smax, PINS0, PINS1);
        if (endgaps)
            fprintf(fx,
            "<endgaps penalized. left endgap: %d %s%s, right endgap: %d %s%s\n",
                firstgap, (dna)? "base" : "residue", (firstgap = = 1)? "" : "s",
                lastgap, (dna)? "base" : "residue", (lastgap = = 1)? "" : "s");
        else
            fprintf(fx, "<endgaps not penalized\n");
}
static      nm;                 /* matches in core -- for checking */
static      lmax;               /* lengths of stripped file names */
static      ij[2];              /* jmp index for a path */
static      nc[2];              /* number at start of current line */
static      ni[2];              /* current elem number -- for gapping */
static      siz[2];
static char *ps[2];             /* ptr to current element */
static char *po[2];             /* ptr to next output char slot */
static char out[2][P_LINE];     /* output line */
static char star[P_LINE];       /* set by stars() */
/*
* print alignment of described in struct path pp[]
*/
static
pr_align()                                                                                  pr_align
{
    int     nn;             /* char count */
    int     more;
    register i;
    for (i = 0, lmax = 0; i < 2;i+ +) {
        nn = stripname(namex[i]);
        if (nn > lmax)
            lmax = nn;
        nc[i] = 1;
        ni[i] = 1;
        siz[i] = ij[i] = 0;
        ps[i] = seqx[i];
        po[i] = out[i];
    }
    for (nn = nm = 0, more = 1; more;) {
        for (i = more = 0; i < 2; i+ +) {
            /*
            * do we have more of this sequence?
            */
            if (!*ps[i])
                continue;
            more+ +;
            if (pp[i].spc) {        /* leading space */
                *po[i]+ + = ' ';
                pp[i].spc- -;
            }
            else if (siz[i]) {      /* in a gap */
                *po[i]+ + = '-';
                siz[i]- -;
```

TABLE 1-continued

```
                }
                else {             /* we're putting a seq element
                                    */
                        *po[i] = *ps[i];
                        if (islower(*ps[i]))
                                *ps[i] = toupper(*ps[i]);
                        po[i]+ +;
                        ps[i]+ +;
                        /*
                         * are we at next gap for this seq?
                         */
                        if (ni[i] = = pp[i].x[ij[i]]) {
                                /*
                                 * we need to merge all gaps
                                 * at this location
                                 */
                                siz[i] = = pp[i].n[ij[i]+ +];
                                while (ni[i] = = pp[i].x[ij[i]])
                                        siz[i] += pp[i].n[ij[i]+ +];
                        }
                        ni[i]+ +;
                }
        }
        if (+ +nn = = olen || !more && nn) {
                dumpblock();
                for (i = 0; i < 2; i+ +)
                        po[i] = out[i];
                nn = 0;
        }
    }
}
/*
 * dump a block of lines, including numbers, stars: pr_align()
 */
static
dumpblock()                                                                                                     dumpblock
{
    register i;
    for(i = 0; i < 2; i+ +)
        *po[i]- - = '\0';
    (void) putc('\n', fx);
    for (i = 0; i < 2; i+ +) {
        if (*out[i] && (*out[i] != ' ' || *(po[i]) != ' ')) {
                if (i = = 0)
                        nums(i);
                if (i = = 0 && *out[1])
                        stars();
                putline(i);
                if (i = = 0 && *out[1])
                        fprintf(fx, star);
                if (i = = 1)
                        nums(i);
        }
    }
}
/*
 * put out a number line: dumpblock()
 */
static
nums(ix)                                                                                                        nums
        int     ix;        /* index in out[] holding seq line */
{
    char        nline[P_LINE];
    register    i, j;
    register char  *pn, *px, *py;
    for(pn = nline, i = 0; i < lmax+P_SPC; i+ +, pn+ +)
        *pn = ' ';
    for (i = nc[ix], py = out[ix]; *py; py+ +, pn+ +) {
        if (*py = = ' ' || *py = = '-')
                *pn = ' ';
        else {
                if (i%10 = = 0 || (i = = 1 && nc[ix] != 1)) {
                        j = (i < 0)? -i : i;
                        for (px = pn; j; j/= 10, px- -)
                                *px = j%10 + '0';
                        if (i < 0)
                                *px = '-';
                }
                else
```

TABLE 1-continued

```
                *pn = ' ';
            i++;
        }
    }
    *pn = '\0';
    nc[ix] = i;
    for (pn = nline; *pn; pn++)
        (void) putc(*pn, fx);
    (void) putc('\n', fx);
}
/*
 * put out a line (name, [num], seq. [num]): dumpblock()
 */
static
putline(ix)                                                                     putline
    int     ix;
{
    int         i;
    register char   *px;
    for (px = namex[ix], i = 0; *px && *px != ':'; px+ +, i+ +)
        (void) putc(*px, fx);
    for (;i < lmax+P_SPC; i+ +)
        (void) putc(' ', fx);
    /* these count from 1:
     * ni[] is current element (from 1)
     * nc[] is number at start of current line
     */
    for (px = out[ix]; *px; px++)
        (void) putc(*px&0x7F, fx);
    (void) putc('\n', fx);
}
/*
 * put a line of stars (seqs always in out[0], out[1]): dumpblock()
 */
static
stars()                                                                         stars
{
    int         i;
    register char   *p0, *p1, cx, *px;
    if  (!*out[0] || (*out[0] = = ' ' && *(p0[0]) = = ' ') ||
         !*out[1] || (*out[1] = = ' ' && *(po[1]) = = ' '))
            return;
    px = star;
    for (i = lmax+P_SPC; i; i- -)
        *px+ + = ' ';
    for (p0 = out[0], p1 = out[1]; *p0 && *p1; p0+ +, p1+ +) {
        if (isalpha(*p0) && isalpha(*p1)) {
            if (xbm[*p0-'A']&xbm[*p1-'A']) {
                cx = '*';
                nm++;
            }
            else if (!dna && _day[*p0-'A'][*p1-'A'] > 0)
                cx = '.';
            else
                cx = ' ';
        }
        else
            cx = ' ';
        *px+ + = cx;
    }
    *px+ + = '\n';
    *px = '\0';
}
/*
 * strip path or prefix from pn, return len: pr_align()
 */
static
stripname(pn)                                                                   stripname
    char        *pn;        /* file name (may be path) */
{
    register char       *px, *py;
    py = 0;
    for (px = pn; *px; px+ +)
        if (*px = = '/')
            py = px + 1;
    if (py)
        (void) strcpy(pn, py);
    return(strlen(pn));
}
```

TABLE 1-continued

```
/*
* cleanup() -- cleanup any tmp file
* getseq() -- read in seq, set dna, len, maxlen
* g_calloc() -- calloc() with error checkin
* readjmps() -- get the good jmps, from tmp file if necessary
* writejmps() -- write a filled array of jmps to a tmp file: nw()
*/
#include "nw.h"
#include <sys/file.h>
char    *jname = "/tmp/homgXXXXXX";    /* tmp file for jmps */
FILE    *fj;
int     cleanup();                     /* cleanup tmp file */
long    lseek();
/*
* remove any tmp file if we blow
*/
cleanup(i)
    int     i;
{
    if (fj)
            (void) unlink(jname);
    exit(i);
}
/*
* read, return ptr to seq, set dna, len, maxlen
* skip lines starting with ';', '<', or '>'
* seq in upper or lower case
*/
char   *
getseq(file, len)
    char    *file;         /* file name */
    int     *len;          /* seq len */
{
    char                line[1024], *pseq;
    register char       *px, *py;
    int                 natgc, tlen;
    FILE                *fp;
    if ((fp = fopen(file, "r")) = = 0) {
        fprintf(stderr, "%s: can't read %s\n", prog, file);
        exit(1);
    }
    tlen = natgc = 0;
    while (fgets(line, 1024, fp)) {
        if (*line = = ';' || *line = = '<' || *line = = '>')
                continue;
        for (px = line; *px != '\n'; px++)
            if (isupper(*px) || islower(*px))
                    tlen+ +;
    }
    if ((pseq = malloc((unsigned)(tlen+6))) = = 0) {
        fprintf(stderr, "%s: malloc() failed to get %d bytes for %s\n", prog, tlen+6, file);
        exit(1);
    }
    pseq[0] = pseq[1] = pseq[2] = pseq[3] = '\0';
    py = pseq + 4;
    *len = tlen;
    rewind(fp);
    while (fgets(line, 1024, fp)) {
        if (*line = = ';' || *line = = '<' || *line = = '>')
                continue;
        for (px = line; *px != '\n'; px+ +) {
            if (isupper(*px))
                    *py+ + = *px;
            else if (islower(*px))
                    *py++ = toupper(*px);
            if (index("ATGCU", *(py-1)))
                    natgc++;
        }
    }
    *py+ + = '\0';
    *py = '\0';
    (void) fclose(fp);
    dna = natgc > (tlen/3);
    return(pseq+4);
}
char   *
g_calloc(msg, nx, sz)
    char    *msg;          /* program, calling routine */
    int     nx, sz;        /* number and size of elements */
```

TABLE 1-continued

```
{
    char        *px, *calloc();
    if ((px = calloc((unsigned)nx, (unsigned)sz)) = = 0) {
        if (*msg) {
            fprintf(stderr, "%s: g_calloc() failed %s (n= %d, sz= %d)\n", prog, msg, nx, sz);
            exit(1);
        }
    }
    return(px);
}
/*
 * get final jmps from dx[] or tmp file, set pp[], reset dmax: main()
 */
readjmps()                                                                                                      readjmps
{
    int         fd = -1;
    int         siz, i0, i1;
    register i, j, xx;
    if (fj) {
        (void) fclose(fj);
        if ((fd = open(jname, O_RDONLY, 0)) < 0) {
            fprintf(stderr, "%s: can't open() %s\n", prog, jname);
            cleanup(1);
        }
    }
    for (i = i0 = i1 = 0, dmax0 = dmax, xx = len0; ;i+ +) {
        while (1) {
            for (j = dx[dmax].ijmp; j >= 0 && dx[dmax].jp.x[j] >= xx; j- -)
                ;
            if (j < 0 && dx[dmax].offset && fj) {
                (void) lseek(fd, dx[dmax].offset, 0);
                (void) read(fd, (char *)&dx[dmax].jp, sizeof(struct jmp));
                (void) read(fd, (char *)&dx[dmax].offset, sizeof(dx[dmax].offset));
                dx[dmax].ijmp = MAXJMP-1;
            }
            else
                break;
        }
        if (i >= JMPS) {
            fprintf(stderr, "%s: too many gaps in alignment\n", prog);
            cleanup(1);
        }
        if (j >= 0) {
            siz = dx[dmax].jp.n[j];
            xx = dx[dmax].jp.x[j];
            dmax += siz;
            if (siz < 0) {              /* gap in second seq */
                pp[1].n[i1] = -siz;
                xx += siz;
                /* id = xx - yy + len1 - 1
                 */
                pp[1].x[i1] = xx - dmax + len1 - 1;
                gapy++;
                ngapy -= siz;
/* ignore MAXGAP when doing endgaps */
                siz = (-siz < MAXGAP || endgaps)? -siz : MAXGAP;
                i1+ +;
            }
            else if (siz > 0) {         /* gap in first seq */
                pp[0] .n[i0] = siz;
                pp[0] .x[i0] = xx;
                gapx++;
                ngapx += siz;
/* ignore MAXGAP when doing endgaps */
                siz = (siz < MAXGAP || endgaps)? siz : MAXGAP;
                i0++;
            }
        }
        else
            break;
    }
    /* reverse the order of jmps
     */
    for (j = 0, i0- -; j < i0; j+ +, i0- -) {
        i = pp[0].n[j]; pp[0].n[j] = pp[0].n[i0]; pp[0].n[i0] = i;
        i = pp[0].x[j]; pp[0].x[j] = pp[0].x[i0]; pp[0].x[i0] = i;
    }
    for (j = 0, i1- -; j < i1; j+ +, i1- -) {
        i = pp[1].n[j]; pp[1].n[j] = pp[1].n[i1]; pp[1].n[i1] = i;
```

TABLE 1-continued

```
        i = pp[1].x[j]; pp[1].x[j] = pp[1].x[i1]; pp[1].x[i1] = i;
    }
    if (fd >= 0)
        (void) close(fd);
    if (fj) {
        (void) unlink(jname);
        fj = 0;
        offset = 0;
    }
}
/*
 * write a filled jmp struct offset of the prev one (if any): nw()
 */
writejmps(ix)                                                                    writejmps
    int    ix;
{
    char    *mktemp();
    if (!fj) {
        if (mktemp(jname) < 0) {
            fprintf(stderr, "%s: can't mktemp() %s\n", prog, jname);
            cleanup(1);
        }
        if ((fj = fopen(jname, "w")) = = 0) {
            fprintf(stderr, "%s: can't write %s\n", prog, jname);
            exit(1);
        }
    }
    (void) fwrite((char *)&dx[ix].jp, sizeof(struct jmp), 1, fj);
    (void) fwrite((char *)&dx[ix].offset, sizeof(dx[ix].offset), 1, fj);
}
```

TABLE 2

| | | |
|---|---|---|
| PRO | XXXXXXXXXXXXXXX | (Length = 15 amino acids) |
| Comparison Protein | XXXXXYYYYYYY | (Length = 12 amino acids) |

% amino acid sequence identity = (the number of identically matching amino acid residues between the two polypeptide sequences as determined by ALIGN-2) divided by (the total number of amino acid residues of the PRO polypeptide) = 5 divided by 15 = 33.3%

TABLE 3

| | | |
|---|---|---|
| PRO | XXXXXXXXXX | (Length = 10 amino acids) |
| Comparison Protein | XXXXXYYYYYYZZYZ | (Length = 15 amino acids) |

% amino acid sequence identity = (the number of identically matching amino acid residues between the two polypeptide sequences as determined by ALIGN-2) divided by (the total number of amino acid residues of the PRO polypeptide) = 5 divided by 10 = 50%

TABLE 4

| | | |
|---|---|---|
| PRO-DNA | NNNNNNNNNNNNNN | (Length = 14 nucleotides) |
| Comparison DNA | NNNNNNLLLLLLLLLL | (Length = 16 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 6 divided by 14 = 42.9%

TABLE 5

| | | |
|---|---|---|
| PRO-DNA | NNNNNNNNNNNN | (Length = 12 nucleotides) |
| Comparison DNA | NNNNLLLVV | (Length = 9 nucleotides) |

% nucleic acid sequence identity = (the number of identically matching nucleotides between the two nucleic acid sequences as determined by ALIGN-2) divided by (the total number of nucleotides of the PRO-DNA nucleic acid sequence) = 4 divided by 12 = 33.3%

II. Compositions and Methods of the Invention

The present invention provides newly identified and isolated nucleotide sequences encoding polypeptides referred to in the present application as PRO polypeptides. In particular, cDNAs encoding various PRO polypeptides have been identified and isolated, as disclosed in further detail in the Examples below. It is noted that proteins produced in separate expression rounds may be given different PRO numbers but the UNQ number is unique for any given DNA and the encoded protein, and will not be changed. However, for sake of simplicity, in the present specification the protein encoded by the full length native nucleic acid molecules disclosed herein as well as all further native homologues and variants included in the foregoing definition of PRO, will be referred to as "PRO/number", regardless of their origin or mode of preparation.

As disclosed in the Examples below, various cDNA clones have been deposited with the ATCC. The actual nucleotide sequences of those clones can readily be determined by the skilled artisan by sequencing of the deposited clone using routine methods in the art. The predicted amino acid sequence can be determined from the nucleotide sequence using routine skill. For the PRO polypeptides and encoding nucleic acids described herein, Applicants have identified what is believed to be the reading frame best identifiable with the sequence information available at the time.

A. Full-Length PRO Polypeptides

1. PRO1560

Using the WU-BLAST2 sequence alignment computer program, the full-length native sequence PRO1560 (shown in FIG. 2 and SEQ ID NO:4) has certain amino acid sequence identity with Tspan-6, identified after the discovery of the present inventionherein. Accordingly, it is presently believed that PRO1560 disclosed in the present application is a newly identified member of the tetraspan family.

2. PRO444

The DNA26846-1397 clone was isolated from a human fetal lung library using a trapping technique which selects for nucleotide sequences encoding secreted proteins. Thus, the DNA26846-1397 clone encodes a secreted factor. As far as is known, the DNA26846-1397 sequence encodes a novel factor designated herein as PRO444. Using the WU-BLAST2 sequence alignment computer program, no significant sequence identity with known proteins was revealed.

3. PRO1018

The DNA56107-1415 clone was isolated from a human ovary tumor tissue library using a trapping technique which selects for nucleotide sequences encoding secreted proteins. As far as is known, the DNA56107-1415 sequence encodes a novel factor designated herein as PRO1018; using the WU-BLAST2 sequence alignment computer program, no significant sequence identities to any known proteins were revealed.

4. PRO1773

Using the WU-BLAST2 sequence alignment computer program, it has been found that a portion of the full-length native sequence PRO1773 (shown in FIG. 8 and SEQ ID NO:10) has certain amino acid sequence identity with a portion of the retinol dehydrogenase type II protein of rattus norvegicus (ROH2_RAT). Accordingly, it is presently believed that PRO1773 disclosed in the present application is a newly identified member of the retinol dehydrogenase protein family and may possess activity typical of that protein family.

5. PRO1477

Using the WU-BLAST2 sequence alignment computer program, it has been found that a full-length native sequence PRO1477 (shown in FIG. 10 and SEQ ID NO:12) has certain amino acid sequence identity with the mannosyl-oligosaccharide 1,2-alpha-mannosidase protein (A54408). Accordingly, it is presently believed that PRO1477 disclosed in the present application is a newly identified member of the mannosidase protein family and may possess activity typical of the mannosidase protein family.

6. PRO1478

Using WU-BLAST2 sequence alignment computer programs, it has been found that a full-length native sequence PRO1478 (shown in FIG. 12 and SEQ ID NO:17) has certain amino acid sequence identity with galactosyltransferases. Accordingly, it is presently believed that PRO1478 disclosed in the present application is a newly identified member of the galactosyltransferase family and may possess at least one shared mechanism with other members of this family.

7. PRO831

The DNA56862-1343 clone was isolated from a human uterus library using a trapping technique which selects for nucleotide sequences encoding secreted proteins. Thus, the DNA56862-1343 clone does encode a secreted factor. As far as is known, the DNA56862-1343 sequence encodes a novel factor designated herein as PRO831; using the WU-BLAST2 sequence alignment computer program, no sequence identities to any known proteins were revealed.

8. PRO1113

Using the WU-BLAST2 sequence alignment computer programs, it has been found that a full-length native sequence PRO1113 (shown in FIG. 16 and SEQ ID NO:24) has certain amino acid sequence identity with LIG-1 and SLIT. Accordingly, it is presently believed that PRO1113 disclosed in the present application is a newly identified member of the leucine rich repeat family and may possess protein-protein interaction activity as is typical of this family.

9. PRO1194

As far as is known, the DNA57841-1522 sequence encodes a novel factor designated herein as PRO1194; using WU-BLAST2 sequence alignment computer programs, limited sequence identities to known proteins were revealed.

10. PRO1110

Using the WU-BLAST2 sequence alignment computer program, it has been found that a full-length native sequence PRO1110 (shown in FIG. 20 and SEQ ID NO:31) has certain amino acid sequence identity with the murine myeloid upregulated protein. Accordingly, it is presently believed that PRO1110 disclosed in the present application is a newly identified member of the myeloid upregulated protein family and may possess activity typical of that family.

11. PRO1378

The DNA58730-1607 clone was isolated from a bone marrow library using a trapping technique which selects fornucleotide sequences encoding secreted proteins. Thus, the DNA58730-1607 clone encodes a secreted factor. As far as is known, the DNA58730-1607 sequence encodes a novel factor designated herein as PRO1378. WU-BLAST2 sequence alignment computer programs revealed some sequence identities between the amino acid sequence of PRO1378 with known proteins. However, they were determined to not be significant.

12. PRO1481

As far as is known, the DNA58732-1650 sequence encodes a novel factor designated herein as PRO1481. Using WU-BLAST2 sequence alignment computer programs, only some sequence identities to known proteins were revealed.

13. PRO1189

Using WU-BLAST2 sequence alignment computer programs, it has been found that a full-length native sequence PRO1189 (shown in FIG. 26 and SEQ ID NO:43) has certain amino acid sequence identity with the amino acid sequence of an E25 protein designated "MUSE25A_1" in the Dayhoff database. Accordingly, it is presently believed that PRO1189 disclosed in the present application is a newly identified member of the E25 protein family and may possess activity or properties typical of that family.

14. PRO1415

The DNA58852-1637 clone was isolated from a diseased human prostate tissue library using a trapping technique which selects for nucleotide sequences encoding secreted proteins. As far as is known, the DNA58852-1637 sequence encodes a novel factor designated herein as PRO1415; using the WU-BLAST2 sequence alignment computer program, no significant sequence identities to any known proteins were revealed.

15. PRO1411

As far as is known, the DNA59212-1627 sequence encodes a novel factor designated herein as PRO1411. However, using WU-BLAST2 sequence alignment computer programs, some sequence identities to known proteins were revealed.

16. PRO1295

As far as is known, the DNA59218-1559 sequence encodes a novel factor designated herein as PRO1295. Using WU-BLAST2 sequence alignment computer programs, only some sequence identities to known proteins were revealed.

17. PRO1359

Using WU-BLAST2 sequence alignment computer programs, it has been found that a full-length native sequence PRO1359 (shown in FIG. 34 and SEQ ID NO:56) has certain amino acid sequence identity with N-acetylgalactosamine alpha-2,6-sialyltransferase. Accordingly, it is presently believed that PRO1359 disclosed in the present application is a newly identified member of the sialyltransferase family and may possess transferase activity typical of this family.

18. PRO1190

Using WU-BLAST2 sequence alignment computer programs, it has been found that a full-length native sequence PRO1190 (shown in FIG. 36 and SEQ ID NO:58) has certain amino acid sequence identity with both rat and human CDO. Accordingly, it is presently believed that PRO1190 disclosed in the present application is a newly identified member of the CDO family and may possess cell adhesion activity typical of the CDO family.

19. PRO1772

Using the WU-BLAST2 sequence alignment computer program, it has been found that a portion of the full-length native sequence PRO1772 (shown in FIG. 38 and SEQ ID NO:63) has certain amino acid sequence identity with a human microsomal dipeptidase protein (P_R13857). Accordingly, it is presently believed that PRO1772 disclosed in the present application is a newly identified member of the peptidase protein family and may possess activity typical of that protein family.

20. PRO1248

Using the WU-BLAST2 sequence alignment computer program, it has been found that a full-length native sequence PRO1248 (shown in FIG. 40 and SEQ ID NO:68) has amino acid sequence identity with the PUT-2 protein (AF026198_5). Accordingly, it is presently believed that PRO1248 disclosed in the present application is a newly PUT-2 homolog and may possess activity typical of the PUT-2 protein.

21. PRO1316

Using WU-BLAST2 sequence alignment computer programs, it has been found that a full-length native sequence PRO1316 (shown in FIG. 42 and SEQ ID NO:70) has certain amino acid sequence identity with murine dickkopf. Accordingly, it is presently believed that PRO1316 disclosed in the present application is a newly identified member of the dickkopf family and may possess the ability to cause head induction from the Spemann organizer and/or Wnt antagonism.

22. PRO1197

As far as is known, the DNA60611-1524 sequence encodes a novel factor designated herein as PRO1197. Using WU-BLAST2 sequence alignment computer programs, only some sequence identities to known proteins were revealed as further described in the examples.

23. PRO1293

Using the WU-BLAST2 sequence alignment computer program, it has been found that a full-length native sequence PRO1293 (shown in FIG. 46 and SEQ ID NO:77) has certain amino acid sequence identity with the human Ig heavy chain V region protein (HSVCD54_1). Accordingly, it is presently believed that PRO1293 disclosed in the present application is a newly identified member of the Ig superfamily of proteins and fragments thereof and may possess activity typical of that family.

24. PRO1380

The DNA60740-1615 clone was isolated from a human retina library. As far as is known, the DNA60740-1615 sequence encodes a novel multi-span transmembrane polypeptide designated herein as PRO1380. Using WU-BLAST2 sequence alignment computer programs, some sequence identity with known proteins were revealed.

25. PRO1265

Using WU-BLAST2 sequence alignment computer programs, it has been found that a full-length native sequence PRO1265 (shown in FIG. 50 and SEQ ID NO:84) has certain amino acid sequence identity with the FIG. 1 polypeptide designated "MMU70429_1" in the Dayhoff database (version 35.45 SwissProt 35). Accordingly, it is presently believed that PRO1265 disclosed in the present application is a newly identified member of the FIG. 1 family and may possess activity typical of the FIG. 1 polypeptide, including activation by interleukin-4.

26. PRO1250

Using the WU-BLAST2 sequence alignment computer program, it has been found that a full-length native sequence PRO1250 (shown in FIG. 52 and SEQ ID NO:86) has certain amino acid sequence identity with the human long chain fatty acid CoA ligase protein (LCFB_HUMAN). Accordingly, it is presently believed that PRO1250 disclosed in the present application is a newly identified long chain fatty acid CoA ligase homolog that may have activity typical of long chain fatty acis CoA ligase.

27. PRO1475

Using the WU-BLAST2 sequence alignment computer program, it has been found that a full-length native sequence PRO1475 (shown in FIG. 54 and SEQ ID NO:88) has certain amino acid sequence identity with a portion of the mouse alpha-3-D-mannoside beat-1,2-N-acetylglucosaminyltransferase I protein. Accordingly, it is presently believed that PRO1475 disclosed in the present application is a newly identified member of the N-acetylglucosaminyltransferase protein family and may possess activity typical of that protein family.

28. PRO1377

As described herein, WU-BLAST2 sequence alignment computer programs were used to determine the sequence identity of the PRO1377 amino acid sequence with the amino acid sequences of known proteins. While some sequence identities were revealed, they were determined to not be significant. Accordingly, as far as is known, the DNA61608 sequence encodes a novel transmembrane protein designated herein as PRO1377.

29. PRO1326

The DNA62808-1582 clone is believed to encode a secreted factor. As far as is known, the DNA62808-1582 sequence encodes a novel factor designated herein as PRO1326; using WU-BLAST2 sequence alignment computer programs, sequence identities to known proteins were revealed but determined not to be significant.

30. PRO1249

The DNA62809-1531 clone was isolated from a human colon tumor tissue library using a trapping technique which selects for nucleotide sequences encoding secreted proteins. As far as is known, the DNA62809-1531 sequence encodes a novel factor designated herein as PRO1249; using the WU-BLAST2 sequence alignment computer program, no sequence identities to any known proteins were revealed.

31. PRO1315

Using the WU-BLAST2 sequence alignment computer program, it has been found that a full-length native sequence PRO1315 (shown in FIG. 62 and SEQ ID NO:104) has certain amino acid sequence identity with the class II cytokine receptor 4 protein of mus musculus (MMU53696_1). Accordingly, it is presently believed that PRO1315 disclosed in the present application is a newly identified member of the cytokine reeptor protein family and may possess activity typical of that family.

32. PRO1599

Using WU-BLAST2 sequence alignment computer programs, it has been found that a full-length native sequence PRO1599 (shown in FIG. 64 and SEQ ID NO:111) has certain amino acid sequence identity with Dayhoff sequence "CFAD_PIG". Accordingly, it is presently believed that PRO1599 disclosed in the present application is a newly identified member of the Granzyme M family and may possess activity or properties typical of the Granzyme M family.

33. PRO1430

Using WU-BLAST2 sequence alignment computer programs, it has been found that a full-length native sequence PRO1430 (shown in FIG. 66 and SEQ ID NO:116) has certain amino acid sequence identity prostate specific reductase (designated "P_W03198" in the Dayhoff database). Accordingly, it is presently believed that PRO1430 disclosed in the present application is a newly identified member of the reductase family and may possess activity typical of members of the reductase family.

34. PRO1374

As far as is known, the DNA64849-1604 sequence encodes a novel factor designated herein as PRO1374; using WU-BLAST2 sequence alignment computer programs, some sequence identities to known proteins such as the human alpha subunit of P4HA were revealed. Therefore, it is believed that PRO1374 is related to P4HA and may share one or more mechanisms.

35. PRO1311

The DNA64863-1573 clone was isolated from human aortic endothelial cells and is believed to encode a novel transmembrane polypeptide designated herein as PRO1311. Using WU-BLAST2 sequence alignment computer programs, some sequence identities with known proteins were revealed, but were determined to not be significant.

36. PRO1357

Using the WU-BLAST2 sequence alignment computer program, it has been found that a full-length native sequence PRO1357 (shown in FIG. 72 and SEQ ID NO:128) has certain amino acid sequence identity with the von Ebner minor salivary gland protein of mus musculus (MMU46068_1). Accordingly, it is presently believed that PRO1357 disclosed in the present application is a newly identified von Ebner minor salivary gland protein homolog.

37. PRO1244

Using WU-BLAST2 sequence alignment computer programs, it has been found that a full-length native sequence PRO1244 (shown in FIG. 74 and SEQ ID NO:130) has certain amino acid sequence identity with a known implantation-associated protein designated "AF008554_1" on the Dayhoff database (version 35.45 SwissProt 35). Accordingly, it is presently believed that PRO1244 disclosed in the present application is a newly identified member of the implantation-associated protein family and may possess attachment activity typical of that protein family.

38. PRO1246

Using the WU-BLAST2 sequence alignment computer program, it has been found that a full-length native sequence PRO1246 (shown in FIG. 76 and SEQ ID NO:132) has certain amino acid sequence identity with the murine bone-related sulphatase-like precursor protein (P_R51355). Accordingly, it is presently believed that PRO1246 disclosed in the present application is a newly identified bone-related sulphatase homolog and may possess activity typical of bone-related sulfatase.

39. PRO1356

Using the WU-BLAST2 sequence alignment computer program, it has been found that a full-length native sequence PRO1356 (shown in FIG. 78 and SEQ ID NO:134) has certain amino acid sequence identity with the CPE-receptor protein of mus musculus (AB000713_1). Accordingly, it is presently believed that PRO1356 disclosed in the present application is a newly identified member of the CPE receptor family and may possess activity typical of that family.

40. PRO1275

As far as is known, the DNA64888-1542 sequence encodes a novel factor designated herein as PRO1275. Using WU-BLAST2 sequence alignment computer programs, some sequence identities to known proteins were revealed.

41. PRO1274

As far as is known, the DNA64889-1541 sequence encodes a novel factor designated herein as PRO1274. Using WU-BLAST2 sequence alignment computer programs, some sequence identities to known proteins were revealed.

42. PRO1412

The DNA64897-1628 clone is believed to be a secreted factor. As far as is known, the DNA64897-1628 sequence encodes a novel factor designated herein as PRO1412; using WU-BLAST2 sequence alignment computer programs, sequence identities to known proteins were revealed but determined not to be significant.

43. PRO1557

Using WU-BLAST2 sequence alignment computer programs, it has been found that a full-length native sequence PRO1557 (shown in FIG. 86; SEQ ID NO:142) has certain amino acid sequence identity chordin protein designated AF034606_1 in the Dayhoff database. Accordingly, it is presently believed that PRO1557 disclosed in the present application is a newly identified member of the chordin family and may possess activity typical of the chordin family.

44. PRO1286

The DNA64903-1553 clone identified using techniques which selects for nucleotide sequences encoding secreted proteins. As far as is known, the DNA64903 sequence encodes a novel secreted factor designated herein as PRO1286. Using WU-BLAST2 sequence alignment computer programs, some sequence identities to known proteins were revealed; however, it was determined that they were not significant.

45. PRO1294

Using the WU-BLAST2 sequence alignment computer program, it has been found that a full-length native sequence PRO1294 (shown in FIG. 90 and SEQ ID NO:146) has certain amino acid sequence identity with the neuronal olfactomedin-related ER localized protein of the rat (I73636). Accordingly, it is presently believed that PRO1294 disclosed in the present application is a newly identified olfactomedin homolog and may possess activity typical of that protein.

46. PRO1347

Using WU-BLAST2 sequence alignment computer programs, it has been found that a full-length native sequence PRO1347 (shown in FIG. 92 and SEQ ID NO:148) has certain amino acid sequence identity with butyrophilin. Moreover, there is a transmembrane domain approximately in the middle of the sequence as is typical of butyrophilins. Accordingly, it is presently believed that PRO1347 dis-

47. PRO1305

The DNA64952-1568 clone was isolated from a human fetal kidney library using a trapping technique which selects for nucleotide sequences encoding secreted proteins. Thus, the DNA64952-1568 clone does encode a secreted factor. As far as is known, the DNA64952-1568 sequence encodes a novel factor designated herein as PRO1305; using the WU-BLAST2 sequence alignment computer program, no sequence identities to any known proteins were revealed.

48. PRO1273

Using WU-BLAST2 sequence alignment computer programs, it has been found that a full-length native sequence PRO1273 (shown in FIG. 96 and SEQ ID NO:158) has certain amino acid sequence identity with a lipocalin precursor. Moreover, FIG. 96 shows that PRO1273 has a motif conserved in lipocalins. Accordingly, it is presently believed that PRO1273 disclosed in the present application is a newly identified member of the lipocalin family and shares at least one mechanism with lipocalins.

49. PRO1302

Using WU-BLAST2 sequence alignment computer programs, it has been found that a full-length native sequence PRO1302 (shown in FIG. 98 and SEQ ID NO:160) has certain amino acid sequence identity with CD33L1 and CD33L2. Accordingly, it is presently believed that PRO1302 disclosed in the present application is a newly identified member of the sialoadhesin family and possesses characteristics typical of this family. Specifically, PRO1302 may be involved in cancer, inflammation, hemopoisis, neuronal development and/or immunity.

50. PRO1283

Using the WU-BLAST2 sequence alignment computer program, it has been found that a full-length native sequence PRO1283 (shown in FIG. 100 and SEQ ID NO:162) has certain amino acid sequence identity with the rat odorant binding protein homolog OBP-II precursor (A40464). Accordingly, it is presently believed that PRO1283 disclosed in the present application is a newly odorant binding protein and may possess activity typical of the odorant binding proteins.

51. PRO1279

Using the WU-BLAST2 sequence alignment computer program, it has been found that a full-length native sequence PRO1279 (shown in FIG. 102 and SEQ ID NO:170) has certain amino acid sequence identity with the mouse neuropsin protein (I56559). Accordingly, it is presently believed that PRO1279 disclosed in the present application is a newly identified neuropsin homolog and may possess activity typical of the neuropsin protein.

52. PRO1304

Using the WU-BLAST2 sequence alignment computer program, it has been found that a full-length native sequence PRO1304 (shown in FIG. 104 and SEQ ID NO:180) has certain amino acid sequence identity with the FK-506 binding protein of mus musculus (AF040252_1). Accordingly, it is presently believed that PRO1304 disclosed in the present application is a newly identified member of the FK506 binding protein family and may possess activity typical of that family.

53. PRO1317

Using WU-BLAST2 sequence alignment computer programs, it has been found that a full-length native sequence PRO1317 (shown in FIG. 106 and SEQ ID NO:189) has certain amino acid sequence identity with human CD97 protein. Accordingly, it is presently believed that PRO1317 disclosed in the present application is a leukocyte antigen that may be involved in leukocyte activation.

54. PRO1303

Using WU-BLAST2 sequence alignment computer programs, it has been found that a full-length native sequence PRO1303 (shown in FIG. 108 and SEQ ID NO:194) has certain amino acid sequence identity with neuropsin. Accordingly, it is presently believed that PRO1303 disclosed in the present application is a newly identified member of the serine protease family and may possess catabolic activity typical of this family.

55. PRO1306

Using WU-BLAST2 sequence alignment computer programs, it has been found that a full-length native sequence PRO1306 (shown in FIG. 110 and SEQ ID NO:196) has certain amino acid sequence identity with Dayhoff sequence no. AIF1_HUMAN. Accordingly, it is presently believed that PRO1306 disclosed in the present application is a newly identified member of the AIF1/daintain family and may possess activity and properties typical of AIF1/daintain.

56. PRO1336

Using WU-BLAST2 sequence alignment computer programs, it has been found that a full-length native sequence PRO1336 (shown in FIG. 112 and SEQ ID NO:198) has certain amino acid sequence identity with slit. Accordingly, it is presently believed that PRO1336 disclosed in the present application is a newly identified member of the EGF-repeat family and may possess protein interaction mediation activity.

57. PRO1278

Using WU-BLAST2 sequence alignment computer programs, it has been found that a full-length native sequence PRO1278 (shown in FIG. 114 and SEQ ID NO:203) has certain amino acid sequence identity lysozyme c -1 precursor designated "LYC1_ANAPL" in the Dayhoff database. Accordingly, it is presently believed that PRO1278 disclosed in the present application is a newly identified member of the lysozyme family and may possess hydrolytic and other activity typical of the lysozyme family.

58. PRO1298

Using WU-BLAST2 sequence alignment computer programs, it has been found that a full-length native sequence PRO1298 (shown in FIG. 116 and SEQ ID NO:210) has certain amino acid sequence identity with glycosyltransferase alg2. Accordingly, it is presently believed that PRO1298 disclosed in the present application is a newly identified member of the glycosyltransferase family and may share at least one mechanism with members of this family.

59. PRO1301

Using WU-BLAST2 sequence alignment computer programs, it has been found that a full-length native sequence PRO1301 (shown in FIG. 118 and SEQ ID NO:212) has consistent amino acid sequence identity with cytochrome P450 proteins. Accordingly, it is presently believed that PRO1301 disclosed in the present application is a newly identified member of the cytochrome P450 family and may possess monooxygenase activity typical of the cytochrome P450 family.

60. PRO1268

As far as is known, the DNA66519-1535 sequence encodes a novel transmembrane polypeptide factor designated herein as PRO1268. Using WU-BLAST2 sequence alignment computer programs, sequence identity to a known protein was revealed, but determined to not be significant.

61. PRO1269

Using WU-BLAST2 sequence alignment computer programs, it has been found that a full-length native sequence PRO1269 (shown in FIG. 122 and SEQ ID NO:216) has certain amino acid sequence identity a bovine granulocyte peptide A precursor, designated "P__W23722" on the Dayhoff database (version 35.45 SwissProt 35). Accordingly, it is presently believed that PRO1269 disclosed in the present application is a newly identified member of the granulocyte A peptide family and may possess microbial activity typical of that family of peptides.

62. PRO1327

Using the WU-BLAST2 sequence alignment computer program, it has been found that a full-length native sequence PRO1327 (shown in FIG. 124 and SEQ ID NO:218) has certain amino acid sequence identity with the rat neurexophilin-1 protein (NPH1__RAT). Accordingly, it is presently believed that PRO1327 disclosed in the present application is a newly identified member of the neurexophilin protein family and may possess activity typical of that protein family.

63. PRO1382

Using WU-BLAST2 sequence alignment computer programs, it has been found that a full-length native sequence PRO1382 (shown in FIG. 126 and SEQ ID NO:220) has certain amino acid sequence identity with the amino acid sequence of a known cerebellin-like glycoprotein designated "CERL__RAT" in the Dayhoff database. Accordingly, it is presently believed that PRO1382 disclosed in the present application is a newly identified member of the cerebellin family of neuropeptides and may possess activity and properties typical of cerebellin.

64. PRO1328

The DNA66658-1584 clone was isolated from a human diseased prostate tissue library using a trapping technique which selects for nucleotide sequences encoding proteins. As far as is known, the DNA66658-1584 sequence encodes a novel factor designated herein as PRO1328; using the WU-BLAST2 sequence alignment computer program, no significant sequence identities to any known proteins were revealed.

65. PRO1325

The DNA66659-1593 clone was isolated from a human thymus tissue library using a trapping technique which selects for nucleotide sequences encoding proteins. As far as is known, the DNA66659-1593 sequence encodes a novel factor designated herein as PRO1325; using the WU-BLAST2 sequence alignment computer program, no sequence identities to any known proteins were revealed.

66. PRO1340

Using WU-BLAST2 sequence alignment computer programs, it has been found that a full-length native sequence PRO1340 (shown in FIG. 132 and SEQ ID NO:229) has certain amino acid sequence identity with Dayhoff sequence no. I46536. Accordingly, it is presently believed that PRO1340 disclosed in the present application is a newly identified member of the cadherin family and may possess activity and properties typical of the cadherin family.

67. PRO1339

Using WU-BLAST2 sequence alignment computer programs, it has been found that a full-length native sequence PRO1339 (shown in FIG. 134 and SEQ ID NO:234) has certain amino acid sequence identity with human pancreatic carboxypeptidase and carboxypeptidase a1. Accordingly, it is presently believed that PRO1339 disclosed in the present application is a newly identified member of the carboxypeptidase family and possesses caboxypeptidase activity.

68. PRO1337

Using WU-BLAST2 sequence alignment computer programs, it has been found that a full-length native sequence PRO1337 (shown in FIG. 136 and SEQ ID NO:236) has certain amino acid sequence identity with a human TBG identified as "THBG__HUMAN" in the Dayhoff database. Accordingly, it is presently believed that PRO1337 disclosed in the present application is a newly identified member of the TBG family and may possess thyroid hormone transport capability and have other

69. PRO1342

The DNA66674-1599 clone was isolated from human esophageal tissue. As described in further detail below, using WU-BLAST2 sequence alignment computer programs, some sequence identities to known proteins were revealed. The DNA66674-1599 clone appears to encode for a novel transmembrane polypeptide.

70. PRO1343

The DNA66675-1587 clone was isolated from a human smooth muscle cell tissue library using a trapping technique which selects for nucleotide sequences encoding secreted proteins. Thus, the DNA66675-1587 clone does encode a secreted factor. As far as is known, the DNA66675-1587 sequence encodes a novel factor designated herein as PRO1343; using the WU-BLAST2 sequence alignment computer program, no significant sequence identities to any known proteins were revealed.

71. PRO1480

Using WU-BLAST2 sequence alignment computer programs, it has been found that a full-length native sequence PRO1480 (shown in FIG. 142 and SEQ ID NO:253) has certain amino acid sequence identity with Dayhoff sequence no. 148746. Accordingly, it is presently believed that PRO1480 disclosed in the present application is a newly identified member of the Semaphorin C family

72. PRO1487

Using WU-BLAST2 sequence alignment computer programs, it has been found that a full-length native sequence PRO1487 (FIG. 144; SEQ ID NO:260) has certain amino acid sequence identity with a radical fringe protein designated GGU82088__1 on the Dayhoff database. Accordingly, it is presently believed that PRO1487 disclosed in the present application is a newly identified member of the fringe family and may possess activity typical of the fringe family.

73. PRO1418

As far as is known, the DNA68864-1629 sequence encodes a novel factor designated herein as PRO1418. Using WU-BLAST2 sequence alignment computer programs, sequence identities to known proteins were minimal.

74. PRO1472

Using WU-BLAST2 sequence alignment computer programs, it has been found that a full-length native sequence PRO1472 (shown in FIG. 148 and SEQ ID NO:267) has certain amino acid sequence identity with butyrophilin. Accordingly, it is presently believed that PRO1472 disclosed in the present application is a newly identified member of the butyrophilin family and may possess involvement in lactation.

75. PRO1461

Using WU-BLAST2 sequence alignment computer programs, it has been found that a full-length native sequence PRO1461 (shown in FIG. 150 and SEQ ID NO:269) has certain amino acid sequence identity the trypsin-like enzyme identified as "P_R89435" on the Dayhoff database. Accordingly, it is presently believed that PRO1461 disclosed in the present application is a newly identified member of the serine protease family and may possess serine protease activity, and more particularly, may possess enzymatic activity typical of other trypsin-like enzymes. Homology was also found to exist between the PRO1461 amino acid sequence and other trypsin-like enzymes and serine proteases in the Dayhoff database.

76. PRO1410

The DNA68874-1622 clone was isolated from a human brain meningioma tissue library using a trapping technique which selects for nucleotide sequences encoding proteins. As far as is known, the DNA68874-1622 sequence encodes a novel factor designated herein as PRO1410; using the WU-BLAST2 sequence alignment computer program, no sequence identities to any known proteins were revealed.

77. PRO1568

Using WU-BLAST2 sequence alignment computer programs, it has been found that a full-length native sequence PRO1568 (shown in FIG. 154 and SEQ ID NO:273) has certain amino acid sequence identity to tetraspan 5 and tetraspan 4. Accordingly, it is presently believed that PRO1568 disclosed in the present application is a newly identified member of the tetraspanin family and may possess molecular facilitator activity typical of this family.

78. PRO1570

Using WU-BLAST2 sequence alignment computer programs, it has been found that a full-length native sequence PRO1570 (shown in FIG. 156 and SEQ ID NO:275) has certain amino acid sequence identity with SP60; however, for the first time, the first 199 amino acids (or amino terminal end) of that protein are identified and presented herein. Accordingly, it is presently believed that PRO1570 disclosed in the present application is a newly identified member of the serine protease family and is involved in carcinoma.

79. PRO1317

Using WU-BLAST2 sequence alignment computer programs, it has been found that a full-length native sequence PRO1317 (shown in FIG. 158 and SEQ ID NO:277) has certain amino acid sequence identity with a known semaphorin B protein, designated "I48745" on the Dayhoff database. Accordingly, it is presently believed that PRO1317 disclosed in the present application is a newly identified member of the semaphorin glycoprotein family and may possess activity or properties typical of semaphorins.

80. PRO1780

Using WU-BLAST2 sequence alignment computer programs, it has been found that a full-length native sequence PRO1780 (shown in FIG. 160 and SEQ ID NO:282) has certain amino acid sequence identity with a known glucuronosyltransferase designated "UDA2_RABIT" in the Dayhoff database. Accordingly, it is presently believed that PRO1780 disclosed in the present application is a newly identified member of the glucuronosyltransferase family and may possess enzymatic activity and other properties typical of the glucuronosyltransferase family.

81. PRO1486

Using WU-BLAST2 sequence alignment computer programs, it has been found that a full-length native sequence PRO1486 (shown in FIG. 162 and SEQ ID NO:287) has certain amino acid sequence identity with cerebellin 1 precursor. Accordingly, it is presently believed that PRO1486 disclosed in the present application is a newly identified member of the cerebellin family and shares at least one mechanism with cerebellin.

82. PRO1433

The DNA71184-1634 clone was isolated from a human adrenal gland tissue library using a trapping technique which selects for nucleotide sequences encoding proteins. As far as is known, the DNA71184-1634 sequence encodes a novel factor designated herein as PRO1433; using the WU-BLAST2 sequence alignment computer program, no sequence identities to any known proteins were revealed.

83. PRO1490

Using the WU-BLAST2 sequence alignment computer program, it has been found that a portion of the full-ength native sequence PRO1490 (shown in FIG. 166 and SEQ ID NO:297) has certain amino acid sequence identity with a portion of the 1-acyl-sn-glycerol-3-phosphate acyltransferase protein (S60478). Accordingly, it is presently believed that PRO1490 disclosed in the present application is a newly identified member of the acyltransferase protein family and may possess activity typical of 1-acyl-sn-glycerol-3-phosphate acyltransferase proteins.

84. PRO1482

The DNA71234-1651 clone was isolated from a human adrenal gland library using a trapping technique which selects for nucleotide sequences encoding secreted proteins. Thus, the DNA71234-1651 clone does encode a secreted factor. As far as is known, the DNA71234-1651 sequence encodes a novel factor designated herein as PRO1482; using the WU-BLAST2 sequence alignment computer program, no sequence identities to any known proteins were revealed.

85. PRO1446

As far as is known, the DNA71277-1636 sequence encodes a novel factor designated herein as PRO1446. Using WU-BLAST2 sequence alignment computer programs, minimal sequence identities to known proteins were revealed.

86. PRO1558

Using the WU-BLAST2 sequence alignment computer program, it has been found that a full-length native sequence PRO1558 (shown in FIG. 172 and SEQ ID NO:306) has significant amino acid sequence identity with a methyltransferase protein (CAMT_EUCGU). Accordingly, it is presently believed that PRO1558 disclosed in the present application is a newly identified member of the methyltransferase protein family and may possess activity typical of that protein family.

87. PRO1604

Using WU-BLAST2 sequence alignment computer programs, it has been found that a full-length native sequence PRO1604 (shown in FIG. 174 and SEQ ID NO:308) has certain amino acid sequence identity with the mouse liver cancer-originated cell growth factor designated P_W37483 on the Dayhoff database. Accordingly, it is presently believed that PRO1604 disclosed in the present application is a newly identified member of the HDGF family and may possess growth factor activity typical of other HDGFs.

88. PRO1491

Using the WU-BLAST2 sequence alignment computer program, it has been found that a portion of the full-length native sequence PRO1491 (shown in FIG. 176 and SEQ ID NO:310) has certain amino acid sequence identity with a portion of the collapsin-2 protein of Gallus gallus (GGU28240_1). Accordingly, it is presently believed that PRO1491 disclosed in the present application is a newly identified member of the collapsin protein family and may possess activity typical of that protein family.

89. PRO1431

It has been found that the full-length native sequence PRO1431 shown in FIG. 178 (SEQ ID NO:315) has significant sequence identity with the SH3 domain containing protein SH17_HUMAN. Accordingly, it is presently believed that PRO1431 disclosed in the present application is a newly identified member of proteins having an SH3 domains and may possess signal transduction properties.

90. PRO1563

Using the WU-BLAST2 sequence alignment computer program, it has been found that a portion of a full-length native sequence PRO1563 (shown in FIG. 180 and SEQ ID NO:317) has certain amino acid sequence identity with a portion of the mouse ADAMTS-1 protein (AB001735_1). Accordingly, it is presently believed that PRO1563 disclosed in the present application is a newly identified member of the ADAM protein family and may possess activity typical of that protein family.

91. PRO1565

Using the WU-BLAST2 sequence alignment computer program, it has been found that a portion of the full-length native sequence PRO1565 (shown in FIG. 182 and SEQ ID NO:322) has certain amino acid sequence identity with a portion of the chondromodulin-I protein of rattus norvegicus (AF051425_1). Accordingly, it is presently believed that PRO1565 disclosed in the present application is a newly identified member of the chondromodulin protein family and may possess activity typical of that protein family.

92. PRO1571

Using the WU-BLAST2 sequence alignment computer program, it has been found that a portion of the full-length native sequence PRO1571 (shown in FIG. 184 and SEQ ID NO:324) has certain amino acid sequence identity with a portion of the human *Clostridium perfringens* enterotoxin receptor protein (AB000712_1). Accordingly, it is presently believed that PRO1571 disclosed in the present application is a newly identified CPE-R homolog and may possess activity typical of the CPE-R protein.

93. PRO1572

Using WU-BLAST2 sequence alignment computer programs, it has been found that a full-length native sequence PRO1572 (shown in FIG. 186 and SEQ ID NO:326) has certain amino acid sequence identity with CPE-R. Accordingly, it is presently believed that PRO1572 disclosed in the present application is related to CPE-R and may possess at least one shared mechanism.

94. PRO1573

Using WU-BLAST2 sequence alignment computer programs, it has been found that a full-length native sequence PRO1573 (shown in FIG. 188 and SEQ ID NO:328) has certain amino acid sequence identity with CPE-R. Accordingly, it is presently believed that PRO1573 disclosed in the present application is related to CPE-R and may possesses at least one shared mechanism.

95. PRO1488

Using WU-BLAST2 sequence alignment computer programs, it has been found that a full-length native sequence PRO1488 (FIG. 190; SEQ ID NO:330) has certain amino acid sequence identity with a known CPE-R designated "AB000712_1" on the Dayhoff database. Accordingly, it is presently believed that PRO1488 disclosed in the present application is a newly identified member of the CPE-R family and may possess binding activity typical of the CPE-R family.

96. PRO1489

Using the WU-BLAST2 sequence alignment computer program, it has been found that a portion of the full-length native sequence PRO1489 (shown in FIG. 192 and SEQ ID NO:332) has certain amino acid sequence identity with the *clostridium perfringens* enterotoxin receptor of Cercopithecus aethiops (D88492_1). Accordingly, it is presently believed that PRO1489 disclosed in the present application is a newly identified *clostridium perfringens* enterotoxin receptor homolog and may possess activity typical of the *clostridium perfringens* enterotoxin receptor protein.

97. PRO1474

Using WU-BLAST2 sequence alignment computer programs, it has been found that a full-length native sequence PRO1474 (shown in FIG. 194 and SEQ ID NO:334) has certain amino acid sequence identity with ovomucoid. Accordingly, it is presently believed that PRO1474 disclosed in the present application is a newly identified member of the kazal serine protease inhibitor family and may possess serine protease inhibitory activity typical of this family.

98. PRO1508

The DNA73742-1508 clone was isolated from a human diseased cartilage tissue library. As far as is known, the DNA73742-1508 sequence encodes a novel factor designated herein as PRO1508; although, using WU-BLAST2 sequence alignment computer programs, some sequence identities to known proteins were revealed.

99. PRO1555

The DNA73744-1665 clone was isolated from a human tissue library. As far as is known, the DNA73744 sequence encodes a novel transmembrane protein designated herein as PRO1555. Using WU-BLAST2 sequence alignment computer programs, some sequence identities to known proteins were revealed.

100. PRO1485

Using WU-BLAST2 sequence alignment computer programs, it has been found that a full-length native sequence PRO1485 (shown in FIG. 200 and SEQ ID NO:340) has certain amino acid sequence identity with lysozyme C precursor peptide. Accordingly, it is presently believed that PRO1485 disclosed in the present application is a newly identified member of the lysozyme family and shares at least one like mechanism.

101. PRO1564

Using the WU-BLAST2 sequence alignment computer program, it has been found that a portion of a full-length native sequence PRO1564 (shown in FIG. 202 and SEQ ID NO:347) has certain amino acid sequence identity with a portion of a mouse polypeptide GalNAc transferase T4 protein (MMU73819_1). Accordingly, it is presently believed that PRO1564 disclosed in the present application is a newly identified member of the N-acetylgalactosaminyltransferase protein family and may possess activity typical of that protein family.

102. PRO1755

As far as is known, the DNA76396-1698 sequence encodes a novel transmembrane protein designated herein as PRO1755. Although, some sequence identities to known proteins was revealed using WU-BLAST2 sequence alignment computer programs.

103. PRO1757

The DNA76398-1699 clone was isolated from a human testicular tissue library using a trapping technique which selects for nucleotide sequences encoding proteins. As far as is known, the DNA76398-1699 sequence encodes a novel factor designated herein as PRO1757; using the WU-BLAST2 sequence alignment computer program, no significant sequence identities to any known proteins were revealed.

104. PRO1758

The DNA76399-1700 clone was isolated from a library derived from human thymus tissue obtained from a fetus that died at 17 weeks' gestation from anencephalus. It is believed that the DNA76399-1700 clone encodes a novel secreted factor, designated herein as PRO1758. Using WU-BLAST2 sequence alignment computer programs, significant sequence identity was revealed between the amino acid sequences of PRO1758 and Dayhoff sequence No. AC005328_2.

105. PRO1575

Using WU-BLAST2 sequence alignment computer programs, it has been found that a full-length native sequence PRO1575 (shown in FIG. 210 and SEQ ID NO:358) has certain amino acid sequence identity with Dayhoff sequence no. A12005_1. Accordingly, it is presently believed that PRO1575 disclosed in the present application is a newly identified member of the protein disulfide isomerase family and may possess activity and properties typical of the disulfide isomerase family.

106. PRO1787

Using WU-BLAST2 sequence alignment computer programs, it has been found that a full-length native sequence PRO1787 (shown in FIG. 212 and SEQ ID NO:364) has certain amino acid sequence identity with various species of myelin p0. Accordingly, it is presently believed that PRO1787 disclosed in the present application is a newly identified member of the myelin p0 protein family and may share at least one similar mechanism. It is believed that modulators of PRO1787 may be used to treat myelinp 0 associated disorders, such as neuropathy, hereditary tooth disease, etc.

107. PRO1781

Using WU-BLAST2 sequence alignment computer programs, some sequence identities were found between the PRO1781 amino acid sequence (SEQ ID NO:366) and the amino acid sequences of known proteins, but were not found to be significant. Accordingly, as far as is known, the DNA76522-2500 sequence encodes a novel protein.

108. PRO1556

The DNA76529-1666 clone was isolated from a human breast tumor tissue library. As far as is known, the DNA76529-1666 sequence encodes a novel transmembrane protein designated herein as PRO1556. Using WU-BLAST2 sequence alignment computer programs, some sequence identities to known proteins were revealed.

109. PRO1759

As far as is known, the DNA76531-1701 sequence encodes a novel factor designated herein as PRO1759; using WU-BLAST2 sequence alignment computer programs, limited sequence identities to known proteins were revealed.

110. PRO1760

As far as is known, the DNA76532-1702 sequence encodes a novel factor designated herein as PRO1760; using WU-BLAST2 sequence alignment computer programs, limited sequence identities to known proteins were revealed.

111. PRO1561

Using the WU-BLAST2 sequence alignment computer program, it has been found that a portion of a full-length native sequence PRO1561 (shown in FIG. 222 and SEQ ID NO:378) has certain amino acid sequence identity with a portion of the human phospholipase A2 protein (P_R63053). Accordingly, it is presently believed that PRO1561 disclosed in the present application is a newly identified member of the phospholipase A2 protein family and may possess activity typical of that protein family.

112. PRO1567

Using WU-BLAST2 sequence alignment computer programs, it has been found that a full-length native sequence PRO1567 (FIG. 224; SEQ ID NO:383) has certain amino acid sequence identity with human colon specific gene CSG6 polypeptide, identified as P_W06549 on the Dayhoff database. Accordingly, it is presently believed that PRO1567 disclosed in the present application is a newly identified CSG expression product, and may possess properties typical of such proteins.

113. PRO1693

Using the WU-BLAST2 sequence alignment computer program, it has been found that a portion of the full-length native sequence PRO1693 (shown in FIG. 226 and SEQ ID NO:385) has certain amino acid sequence identity with a portion of a mouse insulin-like growth factor binding protein (ALS_MOUSE). Accordingly, it is presently believed that PRO1693 disclosed in the present application is a newly identified member of the insulin-like growth factor binding protein family and may possess activity typical of that protein family.

114. PRO1784

As far as is known, the DNA77303-2502 sequence encodes a novel factor designated herein as PRO1784; using WU-BLAST2 sequence alignment computer programs, some sequence identities to known proteins were revealed.

115. PRO1605

Using the WU-BLAST2 sequence alignment computer program, it has been found that a portion of the full-length native sequence PRO1605 (shown in FIG. 230 and SEQ ID NO:395) has certain amino acid sequence identity with a portion of the human alpha-1,3-mannosylglycoprotein beta-1,6-n-acetyltransferase protein (GNT5_HUMAN). Accordingly, it is presently believed that PRO1605 disclosed in the present application is a newly identified member of the glycosyltransferase protein family and may possess activity typical of that protein family.

116. PRO1788

Using WU-BLAST2 sequence alignment computer programs, it has been found that a full-length native sequence PRO1788 (shown in FIG. 232 and SEQ ID NO:397) has certain amino acid sequence identity with Dayhoff sequence "GARP_HUMAN", a leucine-rich repeat-containing protein encoded by a gene localized in the 11q14 chromosomal region. Accordingly, it is presently believed that PRO1788 disclosed in the present application is a newly identified member of the leucine-rich repeat-containing family and may possess activity or properties typical of the leucine-rich repeat-containing family.

117. PRO1801

Using the WU-BLAST2 sequence alignment computer program, it has been found that a portion of the full-length native sequence PRO1801 (shown in FIG. 234 and SEQ ID NO:402) has certain amino acid sequence identity with a portion of the IL-19 protein (P_W37935). Accordingly, it is presently believed that PRO1801 disclosed in the present application is a newly identified member of the IL-10-related cytokine family and may possess activity typical of that cytokine family.

118. UCP4

Using the Megalign DNASTAR computer program (and algorithms and parameters in this software set by the manufacturer) (Oxford Molecular Group, Inc.), it has been found that a full-length native sequence UCP4 (shown in FIG. 236 and SEQ ID NO:406) has certain amino acid sequence identity with UCP3, UCP2 and UCP1. Accordingly, it is presently believed that UCP4 disclosed in the present application is a newly identified member of the human uncoupling protein family and may possess activity(s) and/or property(s) typical of that protein family, such as the ability to enhance or supress metabolic rate by affecting mitochondrial membrane potential.
119. PRO193

The present invention provides newly identified and isolated nucleotide sequences encoding polypeptides referred to in the present application as PRO193. In particular, Applicants have identified and isolated cDNA encoding a PRO193 polypeptide, as disclosed in further detail in the Examples below. The PRO193-encoding clone was isolated from a human retina library.

120. PRO1130

Using the WU-BLAST2 sequence alignment computer program, it has been found that a full-length native sequence PRO1130 (shown in FIG. 240 and SEQ ID NO:415) has amino acid sequence identity with the human 2–19 protein. Accordingly, it is presently believed that PRO1130 disclosed in the present application is a newly identified 2–19 protein homolog.

121. PRO1335

Using the WU-BLAST2 sequence alignment computer program, it has been found that a full-length native sequence PRO1335 (shown in FIG. 242 and SEQ ID NO:423) has certain amino acid sequence identity with the human carbonic anhydrase precursor protein (AF037335_1). Accordingly, it is presently believed that PRO1335 disclosed in the present application is a newly identified member of the carbonic anhydrase protein family and may possess activity typical of that family.

122. PRO1329

The DNA66660-1585 clone is believed to encode a secreted factor. As far as is known, the DNA66660-1585 sequence encodes a novel factor designated herein as PRO1329; using WU-BLAST2 sequence alignment computer programs, sequence identities to known proteins were revealed but determined not to be significant.

123. PRO1550

The DNA76393-1664 clone was isolated from a subtracted human breast tumor tissue library. As far as is known, the DNA76393-1664 sequence encodes a novel factor designated herein as PRO1550; using WU-BLAST2 sequence alignment computer programs, sequence identities to known proteins were revealed but determined not to be significant.

B. PRO Variants

In addition to the full-length native sequence PRO polypeptides described herein, it is contemplated that PRO variants can be prepared. PRO variants can be prepared by introducing appropriate nucleotide changes into the PRO DNA, and/or by synthesis of the desired PRO polypeptide. Those skilled in the art will appreciate that amino acid changes may alter post-translational processes of the PRO, such as changing the number or position of glycosylation sites or altering the membrane anchoring characteristics.

Variations in the native full-length sequence PRO or in various domains of the PRO described herein, can be made, for example, using any of the techniques and guidelines for conservative and non-conservative mutations set forth, for instance, in U.S. Pat. No. 5,364,934. Variations may be a substitution, deletion or insertion of one or more codons encoding the PRO that results in a change in the amino acid sequence of the PRO as compared with the native sequence PRO. Optionally the variation is by substitution of at least one amino acid with any other amino acid in one or more of the domains of the PRO. Guidance in determining which amino acid residue may be inserted, substituted or deleted without adversely affecting the desired activity may be found by comparing the sequence of the PRO with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence.

PRO polypeptide fragments are provided herein. Such fragments may be truncated at the N-terminus or C-terminus, or may lack internal residues, for example, when compared with a full length native protein. Certain fragments lack amino acid residues that are not essential for a desired biological activity of the PRO polypeptide.

PRO fragments may be prepared by any of a number of conventional techniques. Desired peptide fragments may be chemically synthesized. An alternative approach involves generating PRO fragments by enzymatic digestion, e.g., by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR. Preferably, PRO polypeptide fragments share at least one biological and/or immunological activity with the native PRO polypeptide disclosed herein.

In particular embodiments, conservative substitutions of interest are shown in Table 6 under the heading of preferred substitutions. If such substitutions result in a change in biological activity, then more substantial changes, denominated exemplary substitutions in Table 6, or as further described below in reference to amino acid classes, are introduced and the products screened.

TABLE 6

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the PRO polypeptide are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:
(1) hydrophobic: norleucine, met, ala, val, leu, ile;
(2) neutral hydrophilic: cys, ser, thr;
(3) acidic: asp, glu;
(4) basic: asn, gln, his, lys, arg;
(5) residues that influence chain orientation: gly, pro; and
(6) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis [Carter et al., *Nucl. Acids Res.,* 13:4331 (1986); Zoller et al., *Nucl. Acids Res.,* 10:6487 (1987)], cassette mutagenesis [Wells et al., *Gene,* 34:315 (1985)], restriction selection mutagenesis [Wells et al., *Philos. Trans. R. Soc. London SerA,* 317:415 (1986)] or other known techniques can be performed on the cloned DNA to produce the PRO variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant [Cunningham and Wells, *Science,* 244: 1081–1085 (1989)]. Alanine is also typically preferred because it is the most common amino acid. Further, it is frequently found in both buried and exposed positions [Creighton, *The Proteins,* (W.H. Freeman & Co., N.Y.); Chothia, *J. Mol. Biol.,* 150:1 (1976)]. If alanine substitution does not yield adequate amounts of variant, an isoteric amino acid can be used.

C. Modifications of PRO

Covalent modifications of PRO are included within the scope of this invention. One type of covalent modification includes reacting targeted amino acid residues of a PRO polypeptide with an organic derivatizing agent that is capable of reacting with selected side chains or the N- or C-terminal residues of the PRO. Derivatization with bifunctional agents is useful, for instance, for crosslinking PRO to a water-insoluble support matrix or surface for use in the method for purifying anti-PRO antibodies, and vice-versa. Commonly used crosslinking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis (succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the a-amino groups of lysine, arginine, and histidine side chains [T. E. Creighton, *Proteins: Structure and Molecular Properties,* W.H. Freeman & Co., San Francisco, pp. 79–86 (1983)], acetylation of the N-terminal amine, and amidation of any C-terminal carboxyl group.

Another type of covalent modification of the PRO polypeptide included within the scope of this invention comprises altering the native glycosylation pattern of the polypeptide. "Altering the native glycosylation pattern" is intended for purposes herein to mean deleting one or more carbohydrate moieties found in native sequence PRO (either by removing the underlying glycosylation site or by deleting the glycosylation by chemical and/or enzymatic means), and/or adding one or more glycosylation sites that are not present in the native sequence PRO. In addition, the phrase includes qualitative changes in the glycosylation of the native proteins, involving a change in the nature and proportions of the various carbohydrate moieties present.

Addition of glycosylation sites to the PRO polypeptide may be accomplished by altering the amino acid sequence. The alteration may be made, for example, by the addition of, or substitution by, one or more serine or threonine residues to the native sequence PRO (for O-linked glycosylation sites). The PRO amino acid sequence may optionally be altered through changes at the DNA level, particularly by mutating the DNA encoding the PRO polypeptide at preselected bases such that codons are generated that will translate into the desired amino acids.

Another means of increasing the number of carbohydrate moieties on the PRO polypeptide is by chemical or enzymatic coupling of glycosides to the polypeptide. Such methods are described in the art, e.g., in WO 87/05330 published 11 Sep. 1987, and in Aplin and Wriston, *CRC Crit. Rev. Biochem.,* pp. 259–306 (1981).

Removal of carbohydrate moieties present on the PRO polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., *Arch. Biochem. Biophys.,* 259:52 (1987) and by Edge et al., *Anal. Biochem.,* 118:131 (1981). Enzymatic cleavage of carbohydrate moieties on polypeptides can be achieved by the use of a variety of endo- and exo-glycosidases as described by Thotakura et al., *Meth. Enzymol.,* 138:350 (1987).

Another type of covalent modification of PRO comprises linking the PRO polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The PRO of the present invention may also be modified in a way to form a chimeric molecule comprising PRO fused to another, heterologous polypeptide or amino acid sequence.

In one embodiment, such a chimeric molecule comprises a fusion of the PRO with a tag polypeptide which provides an epitope to which an anti-tag antibody can selectively bind. The epitope tag is generally placed at the amino- or carboxyl-terminus of the PRO. The presence of such epitope-tagged forms of the PRO can be detected using an antibody against the tag polypeptide. Also, provision of the epitope tag enables the PRO to be readily purified by affinity purification using an anti-tag antibody or another type of affinity matrix that binds to the epitope tag. Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., *Mol. Cell. Biol.,* 8:2159–2165 (1988)]; the c-myc tag and the 8F9, 3C7, 6E10, G4, B7 and 9E10 antibodies thereto [Evan et al., *Molecular and Cellular Biology,* 5:3610–3616 (1985)]; and the Herpes Simplex virus glycoprotein D (gD) tag and its antibody [Paborsky et al., *Protein Engineering*, 3(6): 547–553 (1990)]. Other tag polypeptides include the Flag-peptide [Hopp et al., *BioTechnology*, 6:1204–1210 (1988)]; the KT3 epitope peptide [Martin et al., *Science*, 255:192–194 (1992)]; an α-tubulin epitope peptide [Skinner et al., *J. Biol. Chem.*, 266:15163–15166 (1991)]; and the T7 gene 10 protein peptide tag [Lutz-Freyermuth et al., *Proc. Natl. Acad. Sci. USA*, 87:6393–6397 (1990)].

In an alternative embodiment, the chimeric molecule may comprise a fusion of the PRO with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a PRO polypeptide in place of at least one variable region within an Ig molecule. In a particularly preferred embodiment, the immunoglobulin fusion includes the hinge, CH2 and CH3, or the hinge, CH1, CH2 and CH3 regions of an IgG1 molecule. For the production of immunoglobulin fusions see also U.S. Pat. No. 5,428,130 issued Jun. 27, 1995.

D. Preparation of PRO

The description below relates primarily to production of PRO by culturing cells transformed or transfected with a vector containing PRO nucleic acid. It is, of course, contemplated that alternative methods, which are well known in the art, may be employed to prepare PRO. For instance, the PRO sequence, or portions thereof, may be produced by direct peptide synthesis using solid-phase techniques [see, e.g., Stewart et al., *Solid-Phase Peptide Synthesis*, W.H. Freeman Co., San Francisco, Calif. (1969); Merrifield, *J. Am. Chem. Soc.*, 85:2149–2154 (1963)]. In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the PRO may be chemically synthesized separately and combined using chemical or enzymatic methods to produce the full-length PRO.

1. Isolation of DNA Encoding PRO

DNA encoding PRO may be obtained from a cDNA library prepared from tissue believed to possess the PRO mRNA and to express it at a detectable level. Accordingly, human PRO DNA can be conveniently obtained from a cDNA library prepared from human tissue, such as described in the Examples. The PRO-encoding gene may also be obtained from a genomic library or by known synthetic procedures (e.g., automated nucleic acid synthesis).

Libraries can be screened with probes (such as antibodies to the PRO or oligonucleotides of at least about 20–80 bases) designed to identify the gene of interest or the protein encoded by it. Screening the cDNA or genomic library with the selected probe may be conducted using standard procedures, such as described in Sambrook et al., *Molecular Cloning: A Laboratory Manual* (New York: Cold Spring Harbor Laboratory Press, 1989). An alternative means to isolate the gene encoding PRO is to use PCR methodology [Sambrook et al., supra; Dieffenbach et al., *PCR Primer: A Laboratory Manual* (Cold Spring Harbor Laboratory Press, 1995)].

The Examples below describe techniques for screening a cDNA library. The oligonucleotide sequences selected as probes should be of sufficient length and sufficiently unambiguous that false positives are minimized. The oligonucleotide is preferably labeled such that it can be detected upon hybridization to DNA in the library being screened. Methods of labeling are well known in the art, and include the use of radiolabels like $^{32}$P-labeled ATP, biotinylation or enzyme labeling. Hybridization conditions, including moderate stringency and high stringency, are provided in Sambrook et al., supra.

Sequences identified in such library screening methods can be compared and aligned to other known sequences deposited and available in public databases such as GenBank or other private sequence databases. Sequence identity (at either the amino acid or nucleotide level) within defined regions of the molecule or across the full-length sequence can be determined using methods known in the art and as described herein.

Nucleic acid having protein coding sequence may be obtained by screening selected cDNA or genomic libraries using the deduced amino acid sequence disclosed herein for the first time, and, if necessary, using conventional primer extension procedures as described in Sambrook et al., supra, to detect precursors and processing intermediates of mRNA that may not have been reverse-transcribed into cDNA.

2. Selection and Transformation of Host Cells

Host cells are transfected or transformed with expression or cloning vectors described herein for PRO production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in *Mammalian Cell Biotechnology: a Practical Approach*, M. Butler, ed. (IRL Press, 1991) and Sambrook et al., supra.

Methods of eukaryotic cell transfection and prokaryotic cell transformation are known to the ordinarily skilled artisan, for example, $CaCl_2$, $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., *Gene*, 23:315 (1983) and WO 89/05859 published 29 Jun. 1989. For mammalian cells without such cell walls, the calcium phosphate precipitation method of Graham and van der Eb, *Virology*, 52:456–457 (1978) can be employed. General aspects of mammalian cell host system transfections have been described in U.S. Pat. No. 4,399,216. Transformations into yeast are typically carried out according to the method of Van Solingen et al., *J. Bact.*, 130:946 (1977) and Hsiao et al., *Proc. Natl. Acad. Sci.* (*USA*), 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., *Methods in Enzymology*, 185:527–537 (1990) and Mansour et al., *Nature*, 336:348–352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as E. coli K12 strain MM294 (ATCC 31,446); E. coli X1776 (ATCC 31,537); E. coli strain W3110 (ATCC 27,325) and K5 772 (ATCC 53,635). Other suitable prokaryotic host cells include Enterobacteriaceae such as Escherichia, e.g., E. coli, Enterobacter, Erwinia, Klebsiella, Proteus, Salmonella, e.g., Salmonella typhimurium, Serratia, e.g., Serratia marcescans, and Shigella, as well as Bacilli such as B. subtilis and B. licheniformis (e.g., B. licheniformis 41P disclosed in DD 266,710 published 12 Apr. 1989), Pseudomonas such as P. aeruginosa, and Streptomyces. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including E. coli W3110 strain 1A2, which has the complete genotype tonA; E. coli W3110 strain 9E4, which has the complete genotype tonA ptr3; E. coli W3110 strain 27C7 (ATCC 55,244), which has the complete genotype tonA ptr3phoA E15 (argF-lac)169 degP ompT kan$^r$; E. coli W3110 strain 37D6, which has the complete genotype tonA ptr3 phoA E15 (argF-lac)169 degP ompT rbs7 ilvG kan$^r$; E. coli W3110 strain 40B4, which is strain 37D6 with a non-kanamycin resistant degP deletion mutation; and an E. coli strain having mutant periplasmic protease disclosed in U.S. Pat. No. 4,946,783 issued 7 Aug. 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for PRO-encoding vectors. Saccharonyces cerevisiae is a commonly used lower eukaryotic host microorganism. Others include Schizosaccharomyces pombe (Beach and Nurse, Nature, 290: 140 [1981]; EP 139,383 published 2 May 1985); Kluyveromyces hosts (U.S. Pat. No. 4,943,529; Fleer et al., Bio/Technology, 9:968–975 (1991)) such as, e.g., K. lactis (MW98-8C, CBS683, CBS4574; Louvencour et al., J. Bacteriol., 154(2):737–742 [1983]), K. fragilis (ATCC 12,424), K. bulgaricus (ATCC 16,045), K. wickeramii (ATCC 24,178), K. waltii (ATCC 56,500), K. drosophilarum (ATCC 36,906); Van den Berg et al., Bio/Technology, 8:135 (1990)), K. thermotolerans, and K. marianus; yarrowia (EP 402,226); Pichia pastoris (EP 183,070; Sreekrishna et al., J. Basic Microbiol., 28:265–278 [1988]); Candida; Trichodenna reesia (EP 244,234); Neurospora crassa (Case et al., Proc. Natl. Acad. Sci. USA, 76:5259–5263 [1979]); Schwanniomyces such as Schwanniomyces occidentalis (EP 394,538 published Oct. 31, 1990); and filamentous fungi such as, e.g., Neurospora, Penicillium, Tolypocladium (WO 91/00357 published 10 Jan. 1991), and Aspergillus hosts such as A. nidulans (Ballance et al., Biochem. Biophys. Res. Commun., 112:284–289 [1983]; Tilburn et al., Gene, 26:205–221 [1983]; Yelton et al., Proc. Natl. Acad. Sci. USA, 81: 1470–1474 [1984]) and A. niger (Kelly and Hynes, EMBO J., 4:475–479 [1985]). Methylotropic yeasts are suitable herein and include, but are not limited to, yeast capable of growth on methanol selected from the genera consisting of Hansenula, Candida, Kloeckera, Pichia, Saccharomyces, Torulopsis, and Rhodotorula. A list of specific species that are exemplary of this class of yeasts may be found in C. Anthony, The Biochemistry of Methylotrophs, 269 (1982).

Suitable host cells for the expression of glycosylated PRO are derived from multicellular organisms. Examples of invertebrate cells include insect cells such as Drosophila S2 and Spodoptera Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., J. Gen Virol., 36:59 (1977)); Chinese hamster ovary cells/-DHFR (CHO, Urlaub and Chasin, Proc. Natl. Acad. Sci. USA, 77:4216 (1980)); mouse sertoli cells (TM4, Mather, Biol. Reprod., 23:243–251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

3. Selection and Use of a Replicable Vector

The nucleic acid (e.g., cDNA or genomic DNA) encoding PRO may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The PRO may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the PRO-encoding DNA that is inserted into the vector. The signal sequence may be a prokaryotic signal sequence selected, for example, from the group of the alkaline phosphatase, penicllinase, lpp, or heat-stable enterotoxin II leaders. For yeast secretion the signal sequence may be, e.g., the yeast invertase leader, alpha factor leader (including Saccharonyces and Kluyveromyces α-factor leaders, the latter described in U.S. Pat. No. 5,010, 182), or acid phosphatase leader, the C. albicans glucoamylase leader (EP 362,179 published 4 Apr. 1990), or the signal described in WO 90/13646 published 15 Nov. 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2μ plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the PRO-encoding nucleic acid, such as DHFR or thymidine kinase. An appropriate host cell when wild-type DHFR is employed is the CHO cell line deficient in DHFR activity, prepared and propagated as described by Urlaub et al., *Proc. Natl. Acad. Sci. USA*, 77:4216 (1980). A suitable selection gene for use in yeast is the trp1 gene present in the yeast plasmid YRp7 [Stinchcomb et al., *Nature*, 282:39 (1979); Kingsman et al., *Gene*, 7:141 (1979); Tschemper et al., *Gene*, 10:157 (1980)]. The trp1 gene provides a selection marker for a mutant strain of yeast lacking the ability to grow in tryptophan, for example, ATCC No. 44076 or PEP4-1 [Jones, *Genetics*, 85:12 (1977)].

Expression and cloning vectors usually contain a promoter operably linked to the PRO-encoding nucleic acid sequence to direct mRNA synthesis. Promoters recognized by a variety of potential host cells are well known. Promoters suitable for use with prokaryotic hosts include the β-lactamase and lactose promoter systems [Chang et al., *Nature*, 275:615 (1978); Goeddel et al., *Nature*, 281:544 (1979)], alkaline phosphatase, a tryptophan (trp) promoter system [Goeddel, *Nucleic Acids Res.*, 8:4057 (1980); EP 36,776], and hybrid promoters such as the tac promoter [deBoer et al., *Proc. Natl. Acad. Sci. USA*, 80:21–25 (1983)]. Promoters for use in bacterial systems also will contain a Shine-Dalgarno (S.D.) sequence operably linked to the DNA encoding PRO.

Examples of suitable promoting sequences for use with yeast hosts include the promoters for 3-phosphoglycerate kinase [Hitzeman et al., *J. Biol. Chem.*, 255:2073 (1980)] or other glycolytic enzymes [Hess et al., *J. Adv. Enzyme Reg.*, 7:149 (1968); Holland, *Biochemistry*, 17:4900 (1978)], such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

PRO transcription from vectors in mammalian host cells is controlled, for example, by promoters obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the PRO by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100–270), the cytomegalovirus early promoter enhancer, the polyoma enhancer on the late side of the replication origin, and adenovirus enhancers. The enhancer may be spliced into the vector at a position 5' or 3' to the PRO coding sequence, but is preferably located at a site 5'from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding PRO.

Still other methods, vectors, and host cells suitable for adaptation to the synthesis of PRO in recombinant vertebrate cell culture are described in Gething et al., *Nature*, 293:620–625 (1981); Mantei et al., *Nature*, 281:4046 (1979); EP 117,060; and EP 117,058.

4. Detecting Gene Amplification/Expression

Gene amplification and/or expression may be measured in a sample directly, for example, by conventional Southern blotting, Northern blotting to quantitate the transcription of mRNA [Thomas, Proc. Natl. Acad. Sci. USA, 77:5201–5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence PRO polypeptide or against a synthetic peptide based on the DNA sequences provided herein or against exogenous sequence fused to PRO DNA and encoding a specific antibody epitope.

5. Purification of Polypeptide

Forms of PRO may be recovered from culture medium or from host cell lysates. If membrane-bound, it can be released from the membrane using a suitable detergent solution (e.g. Triton-X 100) or by enzymatic cleavage. Cells employed in expression of PRO can be disrupted by various physical or chemical means, such as freeze-thaw cycling, sonication, mechanical disruption, or cell lysing agents.

It may be desired to purify PRO from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms of the PRO. Various methods of protein purification may be employed and such methods are known in the art and described for example in Deutscher, *Methods in Enzymology,* 182 (1990); Scopes, *Protein Purification: Principles and Practice,* Springer-Verlag, New York (1982). The purification a step(s) selected will depend, for example, on the nature of the production process used and the particular PRO produced.

E. Uses for PRO

Nucleotide sequences (or their complement) encoding PRO have various applications in the art of molecular biology, including uses as hybridization probes, in chromosome and gene mapping and in the generation of anti-sense RNA and DNA. PRO nucleic acid will also be useful for the preparation of PRO polypeptides by the recombinant techniques described herein.

The full-length native sequence PRO gene, or portions thereof, may be used as hybridization probes for a cDNA library to isolate the full-length PRO cDNA or to isolate still other cDNAs (for instance, those encoding naturally-occurring variants of PRO or PRO from other species) which have a desired sequence identity to the native PRO sequence disclosed herein. Optionally, the length of the probes will be about 20 to about 50 bases. The hybridization probes may be derived from at least partially novel regions of the full length native nucleotide sequence wherein those regions may be determined without undue experimentation or from genomic sequences including promoters, enhancer elements and introns of native sequence PRO. By way of example, a screening method will comprise isolating the coding region of the PRO gene using the known DNA sequence to synthesize a selected probe of about 40 bases. Hybridization probes may be labeled by a variety of labels, including radionucleotides such as $^{32}$P or $^{35}$S, or enzymatic labels such as alkaline phosphatase coupled to the probe via avidin/biotin coupling systems. Labeled probes having a sequence complementary to that of the PRO gene of the present invention can be used to screen libraries of human cDNA, genomic DNA or mRNA to determine which members of such libraries the probe hybridizes to. Hybridization techniques are described in further detail in the Examples below.

Any EST sequences disclosed in the present application may similarly be employed as probes, using the methods disclosed herein.

Other useful fragments of the PRO nucleic acids include antisense or sense oligonucleotides comprising a singe-stranded nucleic acid sequence (either RNA or DNA) capable of binding to target PRO mRNA (sense) or PRO DNA (antisense) sequences. Antisense or sense oligonucleotides, according to the present invention, comprise a fragment of the coding region of PRO DNA. Such a fragment generally comprises at least about 14 nucleotides, preferably from about 14 to 30 nucleotides. The ability to derive an antisense or a sense oligonucleotide, based upon a cDNA sequence encoding a given protein is described in, for example, Stein and Cohen (*Cancer Res.* 48:2659, 1988) and van der Krol et al. (*BioTechniques* 6:958, 1988).

Binding of antisense or sense oligonucleotides to target nucleic acid sequences results in the formation of duplexes that block transcription or translation of the target sequence by one of several means, including enhanced degradation of the duplexes, premature termination of transcription or translation, or by other means. The antisense oligonucleotides thus may be used to block expression of PRO proteins. Antisense or sense oligonucleotides further comprise oligonucleotides having modified sugar-phosphodiester backbones (or other sugar linkages, such as those described in WO 91/06629) and wherein such sugar linkages are resistant to endogenous nucleases. Such oligonucleotides with resistant sugar linkages are stable in vivo (i.e., capable of resisting enzymatic degradation) but retain sequence specificity to be able to bind to target nucleotide sequences.

Other examples of sense or antisense oligonucleotides include those oligonucleotides which are covalently linked to organic moieties, such as those described in WO 90/10048, and other moieties that increases affinity of the oligonucleotide for a target nucleic acid sequence, such as poly-(L-lysine). Further still, intercalating agents, such as ellipticine, and alkylating agents or metal complexes may be attached to sense or antisense oligonucleotides to modify binding specificities of the antisense or sense oligonucleotide for the target nucleotide sequence.

Antisense or sense oligonucleotides may be introduced into a cell containing the target nucleic acid sequence by any gene transfer method, including, for example, $CaPO_4$-mediated DNA transfection, electroporation, or by using gene transfer vectors such as Epstein-Barr virus. In a preferred procedure, an antisense or sense oligonucleotide is inserted into a suitable retroviral vector. A cell containing the target nucleic acid sequence is contacted with the recombinant retroviral vector, either in vivo or ex vivo. Suitable retroviral vectors include, but are not limited to, those derived from the murine retrovirus M-MuLV, N2 (a retrovirus derived from M-MuLV), or the double copy vectors designated DCT5A, DCT5B and DCT5C (see WO 90/13641).

Sense or antisense oligonucleotides also may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell.

Alternatively, a sense or an antisense oligonucleotide may be introduced into a cell containing the target nucleic acid sequence by formation of an oligonucleotide-lipid complex, as described in WO 90/10448. The sense or antisense oligonucleotide-lipid complex is preferably dissociated within the cell by an endogenous lipase.

Antisense or sense RNA or DNA molecules are generally at least about 5 bases in length, about 10 bases in length, about 15 bases in length, about 20 bases in length, about 25 bases in length, about 30 bases in length, about 35 bases in length, about 40 bases in length, about 45 bases in length, about 50 bases in length, about 55 bases in length, about 60 bases in length, about 65 bases in length, about 70 bases in length, about 75 bases in length, about 80 bases in length, about 85 bases in length, about 90 bases in length, about 95 bases in length, about 100 bases in length, or more.

The probes may also be employed in PCR techniques to generate a pool of sequences for identification of closely related PRO coding sequences.

Nucleotide sequences encoding a PRO can also be used to construct hybridization probes for mapping the gene which encodes that PRO and for the genetic analysis of individuals with genetic disorders. The nucleotide sequences provided herein may be mapped to a chromosome and specific regions of a chromosome using known techniques, such as in situ hybridization, linkage analysis against known chromosomal markers, and hybridization screening with libraries.

When the coding sequences for PRO encode a protein which binds to another protein (example, where the PRO is a receptor), the PRO can be used in assays to identify the other proteins or molecules involved in the binding interaction. By such methods, inhibitors of the receptor/ligand binding interaction can be identified. Proteins involved in such binding interactions can also be used to screen for peptide or small molecule inhibitors or agonists of the binding interaction. Also, the receptor PRO can be used to isolate correlative ligand(s). Screening assays can be designed to find lead compounds that mimic the biological activity of a native PRO or a receptor for PRO. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

Nucleic acids which encode PRO or its modified forms can also be used to generate either transgenic animals or "knock out" animals which, in turn, are useful in the development and screening of therapeutically useful reagents. A transgenic animal (e.g., a mouse or rat) is an animal having cells that contain a transgene, which transgene was introduced into the animal or an ancestor of the animal at a prenatal, e.g., an embryonic stage. A transgene is a DNA which is integrated into the genome of a cell from which a transgenic animal develops. In one embodiment, cDNA encoding PRO can be used to clone genomic DNA encoding PRO in accordance with established techniques and the genomic sequences used to generate transgenic animals that contain cells which express DNA encoding PRO. Methods for generating transgenic animals, particularly animals such as mice or rats, have become conventional in the art and are described, for example, in U.S. Pat. Nos. 4,736,866 and 4,870,009. Typically, particular cells would be targeted for PRO transgene incorporation with tissue-specific enhancers. Transgenic animals that include a copy of a transgene encoding PRO introduced into the germ line of the animal at an embryonic stage can be used to examine the effect of increased expression of DNA encoding PRO. Such animals can be used as tester animals for reagents thought to confer protection from, for example, pathological conditions associated with its overexpression. In accordance with this facet of the invention, an animal is treated with the reagent and a reduced incidence of the pathological condition, compared to untreated animals bearing the transgene, would indicate a potential therapeutic intervention for the pathological condition.

Alternatively, non-human homologues of PRO can be used to construct a PRO "knock out" animal which has a defective or altered gene encoding PRO as a result of homologous recombination between the endogenous gene encoding PRO and altered genomic DNA encoding PRO introduced into an embryonic stem cell of the animal. For example, cDNA encoding PRO can be used to clone genomic DNA encoding PRO in accordance with established techniques. A portion of the genomic DNA encoding PRO can be deleted or replaced with another gene, such as a gene encoding a selectable marker which can be used to monitor integration. Typically, several kilobases of unaltered flanking DNA (both at the 5' and 3' ends) are included in the vector [see e.g., Thomas and Capecchi, *Cell*, 51:503 (1987) for a description of homologous recombination vectors]. The vector is introduced into an embryonic stem cell line (e.g., by electroporation) and cells in which the introduced DNA has homologously recombined with the endogenous DNA are selected [see e.g., Li et al., *Cell*, 69:915 (1992)]. The selected cells are then injected into a blastocyst of an animal (e.g., a mouse or rat) to form aggregation chimeras [see e.g., Bradley, in *Teratocarcinomas and Embryonic Stem Cells: A Practical Approach*, E. J. Robertson, ed. (IRL, Oxford, 1987), pp. 113–152]. A chimeric embryo can then be implanted into a suitable pseudopregnant female foster animal and the embryo brought to term to create a "knock out" animal. Progeny harboring the homologously recombined DNA in their germ cells can be identified by standard techniques and used to breed animals in which all cells of the animal contain the homologously recombined DNA. Knock-out animals can be characterized for instance, for their ability to defend against certain pathological conditions and for their development of pathological conditions due to absence of the PRO polypeptide.

Nucleic acid encoding the PRO polypeptides may also be used in gene therapy. In gene therapy applications, genes are introduced into cells in order to achieve in vivo synthesis of a therapeutically effective genetic product, for example for replacement of a defective gene. "Gene therapy" includes both conventional gene therapy where a lasting effect is achieved by a single treatment, and the administration of gene therapeutic agents, which involves the one time or repeated administration of a therapeutically effective DNA or mRNA. Antisense RNAs and DNAs can be used as therapeutic agents for blocking the expression of certain genes in vivo. It has already been shown that short antisense oligonucleotides can be imported into cells where they act as inhibitors, despite their low intracellular concentrations caused by their restricted uptake by the cell membrane. (Zamecnik et al., *Proc. Natl. Acad. Sci. USA* 83:4143–4146 [1986]). The oligonucleotides can be modified to enhance their uptake, e.g. by substituting their negatively charged phosphodiester groups by uncharged groups.

There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, the calcium phosphate precipitation method, etc. The currently preferred in vivo gene transfer techniques include transfection with viral (typically retroviral) vectors and viral coat protein-liposome mediated transfection (Dzau et al., *Trends in Biotechnology* 11, 205–210 [1993]). In some situations it is desirable to provide the nucleic acid source with an agent that targets the target cells, such as an antibody specific for a cell surface membrane protein or the target cell, a ligand for a receptor on the target cell, etc. Where liposomes are employed, proteins which bind to a cell surface membrane protein associated with endocytosis may be used for targeting and/or to facilitate uptake, e.g. capsid proteins or fragments thereof tropic for a particular cell type, antibodies for proteins which undergo internalization in cycling, proteins that target intracellular localization and enhance intracellular half-life. The technique of receptor-mediated endocytosis is described, for example, by Wu et al., *J. Biol. Chem.* 262, 4429–4432 (1987); and Wagner et al., *Proc. Natl. Acad. Sci. USA* 87, 3410–3414 (1990). For review of gene marking and gene therapy protocols see Anderson et al., *Science* 256, 808–813 (1992).

The PRO polypeptides described herein may also be employed as molecular weight markers for protein electrophoresis purposes and the isolated nucleic acid sequences may be used for recombinantly expressing those markers.

The nucleic acid molecules encoding the PRO polypeptides or fragments thereof described herein are useful for chromosome identification. In this regard, there exists an ongoing need to identify new chromosome markers, since relatively few chromosome marking reagents, based upon actual sequence data are presently available. Each PRO nucleic acid molecule of the present invention can be used as a chromosome marker.

The PRO polypeptides and nucleic acid molecules of the present invention may also be used for tissue typing, wherein the PRO polypeptides of the present invention may be differentially expressed in one tissue as compared to another. PRO nucleic acid molecules will find use for generating probes for PCR, Northern analysis, Southern analysis and Western analysis.

The PRO polypeptides described herein may also be employed as therapeutic agents. The PRO polypeptides of the present invention can be formulated according to known methods to prepare pharmaceutically useful compositions, whereby the PRO product hereof is combined in admixture with a pharmaceutically acceptable carrier vehicle. Therapeutic formulations are prepared for storage by mixing the active ingredient having the desired degree of purity with optional physiologically acceptable carriers, excipients or stabilizers (*Remington's Pharmaceutical Sciences* 16th edition, Osol, A. Ed. (1980)), in the form of lyophilized formulations or aqueous solutions. Acceptable carriers, excipients or stabilizers are nontoxic to recipients at the dosages and concentrations employed, and include buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™ or PEG.

The formulations to be used for in vivo administration must be sterile. This is readily accomplished by filtration through sterile filtration membranes, prior to or following lyophilization and reconstitution.

Therapeutic compositions herein generally are placed into a container having a sterile access port, for example, an intravenous solution bag or vial having a stopper pierceable by a hypodermic injection needle.

The route of administration is in accord with known methods, e.g. injection or infusion by intravenous, intraperitoneal, intracerebral, intramuscular, intraocular, intraarterial or intralesional routes, topical administration, or by sustained release systems.

Dosages and desired drug concentrations of pharmaceutical compositions of the present invention may vary depending on the particular use envisioned. The determination of the appropriate dosage or route of administration is well within the skill of an ordinary physician. Animal experiments provide reliable guidance for the determination of effective doses for human therapy. Interspecies scaling of effective doses can be performed following the principles laid down by Mordenti, J. and Chappell, W. "The use of interspecies scaling in toxicokinetics" In Toxicokinetics and New Drug Development, Yacobi et al., Eds., Pergamon Press, New York 1989, pp. 42–96.

When in vivo administration of a PRO polypeptide or agonist or antagonist thereof is employed, normal dosage amounts may vary from about 10 ng/kg to up to 100 mg/kg of mammal body weight or more per day, preferably about 1 μg/kg/day to 10 mg/kg/day, depending upon the route of administration. Guidance as to particular dosages and methods of delivery is provided in the literature; see, for example, U.S. Pat. Nos. 4,657,760; 5,206,344; or 5,225,212. It is anticipated that different formulations will be effective for different treatment compounds and different disorders, that administration targeting one organ or tissue, for example, may necessitate delivery in a manner different from that to another organ or tissue.

Where sustained-release administration of a PRO polypeptide is desired in a formulation with release characteristics suitable for the treatment of any disease or disorder requiring administration of the PRO polypeptide, microencapsulation of the PRO polypeptide is contemplated. Microencapsulation of recombinant proteins for sustained release has been successfully performed with human growth hormone (rhGH), interferon-(rhIFN-), interleukin-2, and MN rgp120. Johnson et al., *Nat. Med.*, 2:795–799 (1996); Yasuda, *Biomed. Ther.*, 27:1221–1223 (1993); Hora et al., *Bio/Technology*, 8:755–758 (1990); Cleland, "Design and Production of Single Immunization Vaccines Using Polylactide Polyglycolide Microsphere Systems," in *Vaccine Design: The Subunit and Adjuvant Approach*, Powell and Newman, eds, (Plenum Press: New York, 1995), pp. 439–462; WO 97/03692, WO 96/40072, WO 96/07399; and U.S. Pat. No. 5,654,010.

The sustained-release formulations of these proteins were developed using poly-lactic-coglycolic acid (PLGA) polymer due to its biocompatibility and wide range of biodegradable properties. The degradation products of PLGA, lactic and glycolic acids, can be cleared quickly within the human body. Moreover, the degradability of this polymer can be adjusted from months to years depending on its molecular weight and composition. Lewis, "Controlled release of bioactive agents from lactide/glycolide polymer," in: M. Chasin and R. Langer (Eds.), *Biodegradable Polymers as Drug Delivery Systems* (Marcel Dekker: New York, 1990), pp. 1–41.

This invention encompasses methods of screening compounds to identify those that mimic the PRO polypeptide (agonists) or prevent the effect of the PRO polypeptide (antagonists). Screening assays for antagonist drug candidates are designed to identify compounds that bind or complex with the PRO polypeptides encoded by the genes identified herein, or otherwise interfere with the interaction of the encoded polypeptides with other cellular proteins. Such screening assays will include assays amenable to high-throughput screening of chemical libraries, making them particularly suitable for identifying small molecule drug candidates.

The assays can be performed in a variety of formats, including protein-protein binding assays, biochemical screening assays, immunoassays, and cell-based assays, which are well characterized in the art.

All assays for antagonists are common in that they call for contacting the drug candidate with a PRO polypeptide encoded by a nucleic acid identified herein under conditions and for a time sufficient to allow these two components to interact.

In binding assays, the interaction is binding and the complex formed can be isolated or detected in the reaction mixture. In a particular embodiment, the PRO polypeptide encoded by the gene identified herein or the drug candidate is immobilized on a solid phase, e.g., on a microtiter plate, by covalent or non-covalent attachments. Non-covalent attachment generally is accomplished by coating the solid surface with a solution of the PRO polypeptide and drying. Alternatively, an immobilized antibody, e.g., a monoclonal antibody, specific for the PRO polypeptide to be immobilized can be used to anchor it to a solid surface. The assay is performed by adding the non-immobilized component, which may be labeled by a detectable label, to the immobilized component, e.g., the coated surface containing the anchored component. When the reaction is complete, the non-reacted components are removed, e.g., by washing, and complexes anchored on the solid surface are detected. When the originally non-immobilized component carries a detectable label, the detection of label immobilized on the surface indicates that complexing occurred. Where the originally non-immobilized component does not carry a label, complexing can be detected, for example, by using a labeled antibody specifically binding the immobilized complex.

If the candidate compound interacts with but does not bind to a particular PRO polypeptide encoded by a gene identified herein, its interaction with that polypeptide can be assayed by methods well known for detecting protein-protein interactions. Such assays include traditional approaches, such as, e.g., cross-linking, co-immunoprecipitation, and co-purification through gradients or chromatographic columns. In addition, protein-protein interactions can be monitored by using a yeast-based genetic system described by Fields and co-workers (Fields and Song, *Nature* (*London*), 340:245–246 (1989); Chien et al., *Proc. Natl. Acad. Sci. USA*, 88:9578–9582 (1991)) as disclosed by Chevray and Nathans, *Proc. Natl. Acad. Sci. USA*, 89: 5789–5793 (1991). Many transcriptional activators, such as yeast GAL4, consist of two physically discrete modular domains, one acting as the DNA-binding domain, the other one funtioning as the transcription-activation domain. The yeast expression system described in the foregoing publications (generally referred to as the "two-hybrid system") takes advantage of this property, and employs two hybrid proteins, one in which the target protein is fused to the DNA-binding domain of GAL4, and another, in which candidate activating proteins are fused to the activation domain. The expression of a GAL1-lacZ reporter gene under control of a GAL4-activated promoter depends on reconstitution of GAL4 activity via protein-protein interaction. Colonies containing interacting polypeptides are detected with a chromogenic substrate for β-galactosidase. A complete kit (MATCHMAKER™) for identifying protein-protein interactions between two specific proteins using the two-hybrid technique is commercially available from Clontech. This system can also be extended to map protein domains involved in specific protein interactions as well as to pinpoint amino acid residues that are crucial for these interactions.

Compounds that interfere with the interaction of a gene encoding a PRO polypeptide identified herein and other intra- or extracellular components can be tested as follows: usually a reaction mixture is prepared containing the product of the gene and the intra- or extracellular component under conditions and for a time allowing for the interaction and binding of the two products. To test the ability of a candidate compound to inhibit binding, the reaction is run in the absence and in the presence of the test compound. In addition, a placebo may be added to a third reaction mixture, to serve as positive control. The binding (complex formation) between the test compound and the intra- or extracellular component present in the mixture is monitored as described hereinabove. The formation of a complex in the control reaction(s) but not in the reaction mixture containing the test compound indicates that the test compound interferes with the interaction of the test compound and its reaction partner.

To assay for antagonists, the PRO polypeptide may be added to a cell along with the compound to be screened for a particular activity and the ability of the compound to inhibit the activity of interest in the presence of the PRO polypeptide indicates that the compound is an antagonist to the PRO polypeptide. Alternatively, antagonists may be detected by combining the PRO polypeptide and a potential antagonist with membrane-bound PRO polypeptide receptors or recombinant receptors under appropriate conditions for a competitive inhibition assay. The PRO polypeptide can be labeled, such as by radioactivity, such that the number of PRO polypeptide molecules bound to the receptor can be used to determine the effectiveness of the potential antagonist. The gene encoding the receptor can be identified by numerous methods known to those of skill in the art, for example, ligand panning and FACS sorting. Coligan et al., *Current Protocols in Immun.*, 1(2): Chapter 5 (1991). Preferably, expression cloning is employed wherein poly-adenylated RNA is prepared from a cell responsive to the PRO polypeptide and a cDNA library created from this RNA is divided into pools and used to transfect COS cells or other cells that are not responsive to the PRO polypeptide. Transfected cells that are grown on glass slides are exposed to labeled PRO polypeptide. The PRO polypeptide can be labeled by a variety of means including iodination or inclusion of a recognition site for a site-specific protein kinase. Following fixation and incubation, the slides are subjected to autoradiographic analysis. Positive pools are identified and sub-pools are prepared and re-transfected using an interactive sub-pooling and re-screening process, eventually yielding a single clone that encodes the putative receptor.

As an alternative approach for receptor identification, labeled PRO polypeptide can be photoaffinity-linked with cell membrane or extract preparations that express the receptor molecule. Cross-linked material is resolved by PAGE and exposed to X-ray film. The labeled complex containing the receptor can be excised, resolved into peptide fragments, and subjected to protein micro-sequencing. The amino acid sequence obtained from micro-sequencing would be used to design a set of degenerate oligonucleotide probes to screen a cDNA library to identify the gene encoding the putative receptor.

In another assay for antagonists, mammalian cells or a membrane preparation expressing the receptor would be incubated with labeled PRO polypeptide in the presence of the candidate compound. The ability of the compound to enhance or block this interaction could then be measured.

More specific examples of potential antagonists include an oligonucleotide that binds to the fusions of immunoglobulin with PRO polypeptide, and, in particular, antibodies including, without limitation, poly- and monoclonal antibodies and antibody fragments, single-chain antibodies, anti-idiotypic antibodies, and chimeric or humanized versions of such antibodies or fragments, as well as human antibodies and antibody fragments. Alternatively, a potential antagonist may be a closely related protein, for example, a mutated form of the PRO polypeptide that recognizes the receptor but imparts no effect, thereby competitively inhibiting the action of the PRO polypeptide.

Another potential PRO polypeptide antagonist is an antisense RNA or DNA construct prepared using antisense technology, where, e.g., an antisense RNA or DNA molecule acts to block directly the translation of mRNA by hybridizing to targeted mRNA and preventing protein translation. Antisense technology can be used to control gene expression through triple-helix formation or antisense DNA or RNA, both of which methods are based on binding of a polynucleotide to DNA or RNA. For example, the 5' coding portion of the polynucleotide sequence, which encodes the mature PRO polypeptides herein, is used to design an antisense RNA oligonucleotide of from about 10 to 40 base pairs in length. A DNA oligonucleotide is designed to be complementary to a region of the gene involved in transcription (triple helix—see Lee et al., *Nucl. Acids Res.,* 6:3073 (1979); Cooney et al., *Science,* 241: 456 (1988); Dervan et al., *Science,* 251:1360 (1991)), thereby preventing transcription and the production of the PRO polypeptide. The antisense RNA oligonucleotide hybridizes to the mRNA in vivo and blocks translation of the mRNA molecule into the PRO polypeptide (antisense—Okano, *Neurochem.,* 56:560 (1991); *Oligodeoxynucleotides as Antisense Inhibitors of Gene Expression* (CRC Press: Boca Raton, Fla., 1988). The oligonucleotides described above can also be delivered to cells such that the antisense RNA or DNA may be expressed in vivo to inhibit production of the PRO polypeptide. When antisense DNA is used, oligodeoxyribonucleotides derived from the translation-initiation site, e.g., between about −10 and +10 positions of the target gene nucleotide sequence, are preferred.

Potential antagonists include small molecules that bind to the active site, the receptor binding site, or growth factor or other relevant binding site of the PRO polypeptide, thereby blocking the normal biological activity of the PRO polypeptide. Examples of small molecules include, but are not limited to, small peptides or peptide-like molecules, preferably soluble peptides, and synthetic non-peptidyl organic or inorganic compounds.

Ribozymes are enzymatic RNA molecules capable of catalyzing the specific cleavage of RNA. Ribozymes act by sequence-specific hybridization to the complementary target RNA, followed by endonucleolytic cleavage. Specific ribozyme cleavage sites within a potential RNA target can be identified by known techniques. For further details see, e.g., Rossi, *Current Biology,* 4:469–471 (1994), and PCT publication No. WO 97/33551 (published Sep. 18, 1997).

Nucleic acid molecules in triple-helix formation used to inhibit transcription should be single-stranded and composed of deoxynucleotides. The base composition of these oligonucleotides is designed such that it promotes triple-helix formation via Hoogsteen base-pairing rules, which generally require sizeable stretches of purines or pyrimidines on one strand of a duplex. For further details see, e.g., PCT publication No. WO 97/33551, supra.

These small molecules can be identified by any one or more of the screening assays discussed hereinabove and/or by any other screening techniques well known for those skilled in the art.

Uses of the herein disclosed molecules may also be based upon the positive functional assay hits disclosed and described below.

F. Anti-PRO Antibodies

The present invention further provides anti-PRO antibodies. Exemplary antibodies include polyclonal, monoclonal, humanized, bispecific, and heteroconjugate antibodies.

1. Polyclonal Antibodies

The anti-PRO antibodies may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include the PRO polypeptide or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

2. Monoclonal Antibodies

The anti-PRO antibodies may, alternatively, be monoclonal antibodies. Monoclonal antibodies may be prepared using hybridoma methods, such as those described by Kohler and Milstein, *Nature,* 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro.

The immunizing agent will typically include the PRO polypeptide or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice,* Academic Press, (1986) pp. 59–103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.,* 133:3001(1984); Brodeur et al., *Monoclonal Antibody Production Techniques and Applications,* Marcel Dekker, Inc., New York, (1987) pp. 51–63].

The culture medium in which the hybridoma cells are cultured can then be assayed for the presence of monoclonal antibodies directed against PRO. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.,* 107:220 (1980).

After the desired hybridoma cells are identified, the clones may be subcloned by limiting dilution procedures and grown by standard methods [Goding, supra]. Suitable culture media for this purpose include, for example, Dulbecco's Modified Eagle's Medium and RPMI-1640 medium. Alternatively, the hybridoma cells may be grown in vivo as ascites in a mammal.

The monoclonal antibodies secreted by the subclones may be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies may also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences [U.S. Pat. No. 4,816,567; Morrison et al., supra] or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking.

In vitro methods are also suitable for preparing monovalent antibodies. Digestion of antibodies to produce fragments thereof, particularly, Fab fragments, can be accomplished using routine techniques known in the art.

3. Human and Humanized Antibodies

The anti-PRO antibodies of the invention may further comprise humanized antibodies or human antibodies. Humanized forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., *Nature,* 321:522–525 (1986); Riechmann et al., *Nature,* 332:323–329 (1988); and Presta, *Curr. Op. Struct. Biol.,* 2:593–596 (1992)].

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., *Nature,* 321:522–525 (1986); Riechmann et al., *Nature,* 332:323–327 (1988); Verhoeyen et al., *Science,* 239:1534–1536 (1988)], by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, *J. Mol. Biol.* 227:381 (1991); Marks et al., *J. Mol. Biol.,* 222:581 (1991)]. The techniques of Cole et al. and Boerner et al. are also available for the preparation of human monoclonal antibodies (Cole et al., *Monoclonal Antibodies and Cancer Therapy,* Alan R. Liss, p. 77 (1985) and Boerner et al., *J. Immunol.,* 147(1):86–95 (1991)]. Similarly, human antibodies can be made by introducing of human immunoglobulin loci into transgenic arimals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., *Bio/Technology* 10, 779–783 (1992); Lonberg et al., *Nature* 368 856–859 (1994); Morrison, *Nature* 368, 812–13 (1994); Fishwild et al., *Nature Biotechnology* 14, 845–51 (1996); Neuberger, *Nature Biotechnology* 14, 826 (1996); Lonberg and Huszar, *Intern. Rev. Immunol.* 13 65–93 (1995).

4. Bispecific Antibodies

Bispecific antibodies are monoclonal, preferably human or humanized, antibodies that have binding specificities for at least two different antigens. In the present case, one of the binding specificities is for the PRO, the other one is for any other antigen, and preferably for a cell-surface protein or receptor or receptor subunit.

Methods for making bispecific antibodies are known in the art. Traditionally, the recombinant production of bispecific antibodies is based on the co-expression of two immunoglobulin heavy-chain-light-chain pairs, where the two heavy chains have different specificities [Milstein and Cuello, Nature, 305:537–539 (1983)]. Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published May 13, 1993, and in Traunecker et al., EMBO J., 10:3655–3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., Methods in Enzymology, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared can be prepared using chemical linkage. Brennan et al., Science 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Fab' fragments may be directly recovered from E. coli and chemically coupled to form bispecific antibodies. Shalaby et al., J. Exp. Med. 175:217–225 (1992) describe the production of a fully humanized bispecific antibody F(ab')$_2$ molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various technique for making and isolating bispecific antibody fragments directly from recombinant cell culture have also been described. For example, bispecific antibodies have been produced using leucine zippers. Kostelny et al., J. Immunol. 148(5):1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., J. Immunol. 152:5368 (1994). Antibodies with more than two valencies are contemplated. For example, trispecific antibodies can be prepared. Tutt et al., J. Immunol. 147:60 (1991).

Exemplary bispecific antibodies may bind to two different epitopes on a given PRO polypeptide herein. Alternatively, an anti-PRO polypeptide arm may be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular PRO polypeptide. Bispecific antibodies may also be used to localize cytotoxic agents to cells which express a particular PRO polypeptide. These antibodies possess a PRO-binding arm and an arm which binds a cytotoxic agent or a radionuclide chelator, such as EOTUBE, DPTA, DOTA, or TETA. Another bispecific antibody of interest binds the PRO polypeptide and further binds tissue factor (TF).

5. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells [U.S. Pat. No. 4,676,980], and for treatment of HIV infection [WO 91/00360; WO 92/200373; EP 03089]. It is contemplated that the antibodies may be prepared in vitro using known methods in synthetic protein chemistry, including those involving crosslinking agents. For example, immunotoxins may be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

6. Effector Function Engineering

It may be desirable to modify the antibody of the invention with respect to effector function, so as to enhance, e.g., the effectiveness of the antibody in treating cancer. For example, cysteine residue(s) may be introduced into the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., *J. Exp Med.*, 176: 1191–1195 (1992) and Shopes, *J. Immunol.*, 148: 2918–2922 (1992). Homodimeric antibodies with enhanced anti-tumor activity may also be prepared using heterobifunctional cross-linkers as described in Wolff et al. *Cancer Research*, 53: 2560–2565 (1993). Alternatively, an antibody can be engineered that has dual Fc regions and may thereby have enhanced complement lysis and ADCC capabilities. See Stevenson et al., *Anti-Cancer Drug Design*, 3: 219–230 (1989).

7. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, aricin immunotoxin can be prepared as described in Vitetta et al., *Science* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody may be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

8. Immunoliposomes

The antibodies disclosed herein may also be formulated as immunoliposomes. Liposomes containing the antibody are prepared by methods known in the art, such as described in Epstein et al., *Proc. Natl. Acad. Sci. USA*, 82: 3688 (1985); Hwang et al., *Proc. Natl Acad. Sci. USA*, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.*, 257: 286–288 (1982) via a disulfide-interchange reaction. A chemotherapeutic agent (such as Doxorubicin) is optionally contained within the liposome. See Gabizon et al., *J. National Cancer Inst.*, 81(19): 1484 (1989).

9. Pharmaceutical Compositions of Antibodies

Antibodies specifically binding a PRO polypeptide identified herein, as well as other molecules identified by the screening assays disclosed hereinbefore, can be administered for the treatment of various disorders in the form of pharmaceutical compositions.

If the PRO polypeptide is intracellular and whole antibodies are used as inhibitors, internalizing antibodies are preferred. However, lipofections or liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., *Proc. Natl. Acad. Sci. USA*, 90: 7889–7893 (1993). The formulation herein may also contain more than one active compound as necessary for the particular indication being treated, preferably those with complementary activities that do not adversely affect each other. Alternatively, or in addition, the composition may comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles, and nanocapsules) or in macroemulsions. Such techniques are disclosed in Remington's *Pharmaceutical Sciences*, supra.

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly (vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfydryl residues, lyophilizing from acidic solutions, controlling moisture content, using appropriate additives, and developing specific polymer matrix compositions.

G. Uses for anti-PRO Antibodies

The anti-PRO antibodies of the invention have various utilities. For example, anti-PRO antibodies may be used in diagnostic assays for PRO, e.g., detecting its expression in specific cells, tissues, or serum. Various diagnostic assay techniques known in the art may be used, such as competitive binding assays, direct or indirect sandwich assays and immunoprecipitation assays conducted in either heterogeneous or homogeneous phases [Zola, *Monoclonal Antibodies: A Manual of Techniques*, CRC Press, Inc. (1987) pp. 147–158]. The antibodies used in the diagnostic assays can be labeled with a detectable moiety. The detectable moiety should be capable of producing, either directly or indirectly, a detectable signal. For example, the detectable moiety may be a radioisotope, such as $^3$H, $^{14}$C, $^{32}$P, $^{35}$S, or $^{125}$I, a fluorescent or chemiluminescent compound, such as fluorescein isothiocyanate, rhodamine, or luciferin, or an enzyme, such as alkaline phosphatase, beta-galactosidase or horseradish peroxidase. Any method known in the art for conjugating the antibody to the detectable moiety may be employed, including those methods described by Hunter et al., *Nature*, 144:945 (1962); David et al., *Biochemistry*, 13:1014 (1974); Pain et al., *J. Immunol. Meth.*, 40:219 (1981); and Nygren, *J. Histochem. and Cytochem.*, 30:407 (1982).

Anti-PRO antibodies also are useful for the affinity purification of PRO from recombinant cell culture or natural sources. In this process, the antibodies against PRO are immobilized on a suitable support, such a Sephadex resin or filter paper, using methods well known in the art. The immobilized antibody then is contacted with a sample containing the PRO to be purified, and thereafter the support is washed with a suitable solvent that will remove substantially all the material in the sample except the PRO, which is bound to the immobilized antibody. Finally, the support is washed with another suitable solvent that will release the PRO from the antibody.

The following examples are offered for illustrative purposes only, and are not intended to limit the scope of the present invention in any way.

All patent and literature references cited in the present specification are hereby incorporated by reference in their entirety.

EXAMPLES

Commercially available reagents referred to in the examples were used according to manufacturer's instructions unless otherwise indicated. The source of those cells identified in the following examples, and throughout the specification, by ATCC accession numbers is the American Type Culture Collection, Manassas, Va.

Example 1

Extracellular Domain Homology Screening to Identify Novel Polypeptides and cDNA Encoding Therefor The extracellular domain (ECD) sequences (including the secretion signal sequence, if any) from about 950 known secreted proteins from the Swiss-Prot public database were used to search EST databases. The EST databases included public databases (e.g., Dayhoff, GenBank), and proprietary databases (e.g. LIFESEQ™, Incyte Pharmaceuticals, Palo Alto, Calif.). The search was performed using the computer program BLAST or BLAST-2 (Altschul et al., *Methods in Enzymology* 266:460–480 (1996)) as a comparison of the ECD protein sequences to a 6 frame translation of the EST sequences. Those comparisons with a BLAST score of 70 (or in some cases 90) or greater that did not encode known proteins were clustered and assembled into consensus DNA sequences with the program "phrap" (Phil Green, University of Washington, Seattle, Wash.).

Using this extracellular domain homology screen, consensus DNA sequences were assembled relative to the other identified EST sequences using phrap. In addition, the consensus DNA sequences obtained were often (but not always) extended using repeated cycles of BLAST or BLAST-2 and phrap to extend the consensus sequence as far as possible using the sources of EST sequences discussed above.

Based upon the consensus sequences obtained as described above, oligonucleotides were then synthesized and used to identify by PCR a cDNA library that contained the sequence of interest and for use as probes to isolate a clone of the full-length coding sequence for a PRO polypeptide. Forward and reverse PCR primers generally range from 20 to 30 nucleotides and are often designed to give a PCR product of about 100–1000 bp in length. The probe sequences are typically 40–55 bp in length. In some cases, additional oligonucleotides are synthesized when the consensus sequence is greater than about 1–1.5 kbp. In order to screen several libraries for a full-length clone, DNA from the libraries was screened by PCR amplification, as per Ausubel et al., *Current Protocols in Molecular Biology*, with the PCR primer pair. A positive library was then used to isolate clones encoding the gene of interest using the probe oligonucleotide and one of the primer pairs.

The cDNA libraries used to isolate the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

Example 2

Isolation of cDNA Clones by Amylase Screening

1. Preparation of Oligo dT Primed cDNA Library mRNA was isolated from a human tissue of interest using reagents and protocols from Invitrogen, San Diego, Calif. (Fast Track 2). This RNA was used to generate an oligo dT primed cDNA library in the vector pRK5D using reagents and protocols from Life Technologies, Gaithersburg, Md. (Super Script Plasmid System). In this procedure, the double stranded cDNA was sized to greater than 1000 bp and the SalI/NotI linkered cDNA was cloned into XhoI/NotI cleaved vector. pRK5D is a cloning vector that has an sp6 transcription initiation site followed by an SfiI restriction enzyme site preceding the XhoI/NotI cDNA cloning sites.

2. Preparation of Random Primed cDNA Library

A secondary cDNA library was generated in order to preferentially represent the 5' ends of the primary cDNA clones. Sp6 RNA was generated from the primary library (described above), and this RNA was used to generate a random primed cDNA library in the vector pSST-AMY.0 using reagents and protocols from Life Technologies (Super Script Plasmid System, referenced above). In this procedure the double stranded cDNA was sized to 500–1000 bp, Tinkered with blunt to NoI adaptors, cleaved with SfiI, and cloned into SfiI/NotI cleaved vector. pSST-AMY.0 is a cloning vector that has a yeast alcohol dehydrogenase promoter preceding the cDNA cloning sites and the mouse amylase sequence (the mature sequence without the secretion signal) followed by the yeast alcohol dehydrogenase terminator, after the cloning sites. Thus, cDNAs cloned into this vector that are fused in frame with amylase sequence will lead to the secretion of amylase from appropriately transfected yeast colonies.

3. Transformation and Detection

DNA from the library described in paragraph 2 above was chilled on ice to which was added electrocompetent DH10B bacteria (Life Technologies, 20 ml). The bacteria and vector mixture was then electroporated as recommended by the manufacturer. Subsequently, SOC media (Life Technologies, 1 ml) was added and the mixture was incubated at 37° C. for 30 minutes. The transformants were then plated onto 20 standard 150 mm LB plates containing ampicillin and incubated for 16 hours (37° C.). Positive colonies were scraped off the plates and the DNA was isolated from the bacterial pellet using standard protocols, e.g. CsCl-gradient. The purified DNA was then carried on to the yeast protocols below.

The yeast methods were divided into three categories: (1) Transformation of yeast with the plasmid/cDNA combined vector; (2) Detection and isolation of yeast clones secreting amylase; and (3) PCR amplification of the insert directly from the yeast colony and purification of the DNA for sequencing and further analysis.

The yeast strain used was HD56-5A (ATCC-90785). This strain has the following genotype: MAT alpha, ura3-52, leu2-3, leu2-112, his3-11, his3-15, MAL+, SUC+, GAL[30]. Preferably, yeast mutants can be employed that have deficient post-translational pathways. Such mutants may have translocation deficient alleles in sec71, sec72, sec62, with truncated sec71 being most preferred. Alternatively, antagonists (including antisense nucleotides and/or ligands) which interfere with the normal operation of these genes, other proteins implicated in this post translation pathway (e.g., SEC61p, SEC72p, SEC62p, SEC63p, TDJ1p or SSA1p-4p) or the complex formation of these proteins may also be preferably employed in combination with the amylase-expressing yeast.

Transformation was performed based on the protocol outlined by Gietz et al., Nucl. Acid. Res., 20:1425 (1992). Transformed cells were then inoculated from agar into YEPD complex media broth (100 ml) and grown overnight at 30° C. The YEPD broth was prepared as described in Kaiser et al., Methods in Yeast Genetics,Cold Spring Harbor Press, Cold Spring Harbor, N.Y., p. 207 (1994). The overnight culture was then diluted to about $2 \times 10^6$ cells/ml (approx. $OD_{600}=0.1$) into fresh YEPD broth (500 ml) and regrown to $1 \times 10^7$ cells/ml (approx. $OD_{600}=0.4$–0.5).

The cells were then harvested and prepared for transformation by transfer into GS3 rotor bottles in a Sorval GS3 rotor at 5,000 rpm for 5 minutes, the supernatant discarded, and then resuspended into sterile water, and centrifuged again in 50 ml falcon tubes at 3,500 rpm in a Beckman GS-6KR centrifuge. The supernatant was discarded and the cells were subsequently washed with LiAc/TE (10 ml, 10 mM Tris-HCl, 1 mM EDTA pH 7.5, 100 mM $Li_2OOCCH_3$), and resuspended into LiAc/TE (2.5 ml).

Transformation took place by mixing the prepared cells (100 μl) with freshly denatured single stranded salmon testes DNA (Lofstrand Labs, Gaithersburg, Md.) and transforming DNA (1 μg, vol. <10 μl) in microfuge tubes. The mixture was mixed briefly by vortexing, then 40% PEG/TE (600 μl, 40% polyethylene glycol-4000, 10 mM Tris-HCl, 1 mM EDTA, 100 mM $Li_2OOCCH_3$, pH 7.5) was added. This mixture was gently mixed and incubated at 30° C. while agitating for 30 minutes. The cells were then heat shocked at 42° C. for 15 minutes, and the reaction vessel centrifuged in a microfuge at 12,000 rpm for 5–10 seconds, decanted and resuspended into TE (500 μl, 10 mM Tris-HCl, 1 mM EDTA pH 7.5) followed by recentrifugation. The cells were then diluted into TE (1 ml) and aliquots (200 μl) were spread onto the selective media previously prepared in 150 mm growth plates (VWR).

Alternatively, instead of multiple small reactions, the transformation was performed using a single, large scale reaction, wherein reagent amounts were scaled up accordingly.

The selective media used was a synthetic complete dextrose agar lacking uracil (SCD-Ura) prepared as described in Kaiser et al., Methods in Yeast Genetics,Cold Spring Harbor Press, Cold Spring Harbor, N.Y., p. 208–210 (1994). Transformants were grown at 30° C. for 2–3 days.

The detection of colonies secreting amylase was performed by including red starch in the selective growth media. Starch was coupled to the red dye (Reactive Red-120, Sigma) as per the procedure described by Biely et al., Anal. Biochem. 172:176–179 (1988). The coupled starch was incorporated into the SCD-Ura agar plates at a final concentration of 0.15% (w/v), and was buffered with potassium phosphate to a pH of 7.0 (50–100 mM final concentration).

The positive colonies were picked and streaked across fresh selective media (onto 150 mm plates) in order to obtain well isolated and identifiable single colonies. Well isolated single colonies positive for amylase secretion were detected by direct incorporation of red starch into buffered SCD-Ura agar. Positive colonies were determined by their ability to break down starch resulting in a clear halo around the positive colony visualized directly.

4. Isolation of DNA by PCR Amplification

When a positive colony was isolated, a portion of it was picked by a toothpick and diluted into sterile water (30 μl) in a 96 well plate. At this time, the positive colonies were either frozen and stored for subsequent analysis or immediately amplified. An aliquot of cells (5 μl) was used as a template for the PCR reaction in a 25 μl volume containing: 0.5 μl Klentaq (Clontech, Palo Alto, Calif.); 4.0 μl 10 mM dNTP's (Perkin Elmer-Cetus); 2.5 μl Kentaq buffer (Clontech); 0.25 μl forward oligo 1; 0.25 μl reverse oligo 2; 12.5 μl distilled water.

The sequence of the forward oligonucleotide 1 was:

5'-TGTAAAACGACGGCCAGT
TAAATAGACCTGCAATTATTAATCT-3' (SEQ ID NO:1)

The sequence of reverse oligonucleotide 2 was:
5'-CAGGAAACAGCTATGACC <u>ACCTGCACACCTGCAAATCCATT</u>-3' (SEQ ID NO:2)
PCR was then performed as follows:

| a. |              | Denature | 92° C., 5 minutes   |
|----|--------------|----------|---------------------|
| b. | 3 cycles of: | Denature | 92° C., 30 seconds  |
|    |              | Anneal   | 59° C., 30 seconds  |
|    |              | Extend   | 72° C., 60 seconds  |
| c. | 3 cycles of: | Denature | 92° C., 30 seconds  |
|    |              | Anneal   | 57° C., 30 seconds  |
|    |              | Extend   | 72° C., 60 seconds  |
| d. | 25 cycles of:| Denature | 92° C., 30 seconds  |
|    |              | Anneal   | 55° C., 30 seconds  |
|    |              | Extend   | 72° C., 60 seconds  |
| e. |              | Hold     | 4° C.               |

The underlined regions of the oligonucleotides annealed to the ADH promoter region and the amylase region, respectively, and amplified a 307 bp region from vector pSST-AMY.0 when no insert was present. Typically, the first 18 nucleotides of the 5' end of these oligonucleotides contained annealing sites for the sequencing primers. Thus, the total product of the PCR reaction from an empty vector was 343 bp. However, signal sequence-fused cDNA resulted in considerably longer nucleotide sequences.

Following the PCR, an aliquot of the reaction (5 μl) was examined by agarose gel electrophoresis in a 1% agarose gel using a Tris-Borate-EDTA (TBE) buffering system as described by Sambrook et al., supra. Clones resulting in a single strong PCR product larger than 400 bp were further analyzed by DNA sequencing after purification with a 96 Qiaquick PCR clean-up column (Qiagen Inc., Chatsworth, Calif.).

Example 3

Isolation of cDNA Clones Using Signal Algorithm Analysis

Various polypeptide-encoding nucleic acid sequences were identified by applying a proprietary signal sequence finding algorithm developed by Genentech, Inc. (South San Francisco, Calif.) upon ESTs as well as clustered and assembled EST fragments from public (e.g., GenBank) and/or private (LIFESEQ®, Incyte Pharmaceuticals, Inc., Palo Alto, Calif.) databases. The signal sequence algorithm computes a secretion signal score based on the character of the DNA nucleotides surrounding the first and optionally the second methionine codon(s) (ATG) at the 5'-end of the sequence or sequence fragment under consideration. The nucleotides following the first ATG must code for at least 35 unambiguous amino acids without any stop codons. If the first ATG has the required amino acids, the second is not examined. If neither meets the requirement, the candidate sequence is not scored. In order to determine whether the EST sequence contains an authentic signal sequence, the DNA and corresponding amino acid sequences surrounding the ATG codon are scored using a set of seven sensors (evaluation parameters) known to be associated with secretion signals. Use of this algorithm resulted in the identification of numerous polypeptide-encoding nucleic acid sequences.

Example 4

Isolation of cDNA Clones Encoding Human PRO1560

A consensus DNA sequence was assembled relative to other EST sequences using phrap as described in Example 1 above. This consensus sequence is designated herein as DNA17409. Based on the DNA17409 consensus sequence, oligonucleotides were synthesized: 1) to identify by PCR a cDNA library that contained the sequence of interest, and 2) for use as probes to isolate a clone of the full-length coding sequence for PRO1560.

DNA sequencing of the isolated clones isolated as described above gave the full-length DNA sequence for DNA19902-1669 [FIG. 1, SEQ ID NO:3]; and the derived protein sequence for PRO1560.

The entire coding sequence of DNA19902-1669 is included in FIG. 1 (SEQ ID NO:3). Clone DNA19902-1669 contains a single open reading frame with an apparent translational initiation site at nucleotide positions 41–43, and an apparent stop codon at nucleotide positions 776–778. The predicted polypeptide precursor is 245 amino acids long. The approximate locations of the signal peptide, transmembrane domains, N-glycosylation sites, N-myristoylation sites, tyrosine kinase phosphorylation sites, and membrane lipoprotein lipid attachment sites are also indicated in FIG. 2. Clone DNA19902-1669 has been deposited with the ATCC and is assigned ATCC deposit no. 203454. The full-length PRO1560 protein shown in FIG. 2 has an estimated molecular weight of about 27,563 daltons and a pI of about 8.36.

An analysis of the Dayhoff database (version 35.45 SwissProt 35), using a WU-BLAST2 sequence alignment analysis of the full-length sequence shown in FIG. 2 (SEQ ID NO:4), revealed sequence identity between the PRO1560 amino acid sequence and the following Dayhoff sequences: AF053453_1, AF053454_1, A15_HUMAN, AF054840_1, CD63_HUMAN, AF065389_1, AF054838_1, AF089749$_{13}$ 1, P$_{13}$R27525, and P_R86834.

Example 5

Isolation of cDNA Clones Encoding Human PRO444

A cDNA sequence isolated in the amylase screen described in Example 2 above was designated DNA13121. Based upon this sequence, probes were generated and used to screen a human fetal lung library (LIB25) prepared as described in paragraph 1 of Example 2 above. The cloning vector was pRK5B (pRK5B is a precursor of pRK5D that does not contain the SfiI site; see, Holmes et al., Science 253:1278–1280 (1991)), and the cDNA size cut was less than 2800 bp.

A full length clone was identified that contained a single open reading frame with an apparent translational initiation site at nucleotide positions 608–610 and ending at the stop codon found at nucleotide positions 959–961 (FIG. 3, SEQ ID NO:5). The predicted polypeptide precursor is 117 amino acids long, has a calculated molecular weight of approximately 12,692 daltons and an estimated pI of approximately 7.50. Analysis of the full-length PRO444 sequence shown in FIG. 4 (SEQ ID NO:6) evidences the presence of a signal peptide at amino acid 1 to about amino acid 16. An analysis of the Dayhoff database (version 35.45 SwissProt 35) evidenced homology between the PRO444 amino acid sequence and the following Dayhoff sequences: CEF44D12_8, P_R88452, YNE1_CAEEL, A47312, AF009957_1, and A06133_1. Clone DNA26846-1397 was deposited with the ATCC on Oct. 27, 1998 and is assigned ATCC deposit no. 203406.

Example 6

Isolation of cDNA Clones Encoding Human PRO1018

A cDNA clone (DNA56107-1415) encoding a native human PRO1018 polypeptide was identified by a yeast screen, in a human ovary tumor cDNA library that preferentially represents the 5' ends of the primary cDNA clones. The yeast screen employed identified a single EST clone designated herein as DNA41000. The DNA41000 sequence was then compared to various EST databases including public EST databases (e.g., GenBank), and a proprietary EST database (LIFESEQ®, Incyte Pharmaceuticals, Palo Alto, Calif.) to identify homologous EST sequences. The comparison was performed using the computer program BLAST or BLAST2 [Altschul et al., *Methods in Enzymology*, 266:460–480 (1996)]. Those comparisons resulting in a BLAST score of 70 (or in some cases, 90) or greater that did not encode known proteins were clustered and assembled into a consensus DNA sequence with the program "phrap" (Phil Green, University of Washington, Seattle, Wash.). This consensus sequence is herein designated DNA44449. Oligonucleotide primers based upon the DNA44449 sequence were then synthesized and employed to screen a human ovary tumor cDNA library which resulted in the identification of the DNA56107-1415 clone shown in FIG. 5.

The full-length DNA56107-1415 clone shown in FIG. 5 contains a single open reading frame with an apparent translational initiation site at nucleotide positions 129–131 and ending at the stop codon at nucleotide positions 696–698 (FIG. 5). The predicted polypeptide precursor is 189 amino acids long (FIG. 6). Analysis of the full-length PRO1018 sequence shown in FIG. 6 (SEQ ID NO:8) evidences the presence of the following: a signal peptide from about amino acid 1 to about amino acid 24, transmembrane domains from about amino acid 86 to about amino acid 103 and from about amino acid 60 to about amino acid 75 and an amino acid sequence block having homology to G-protein coupled receptor proteins from about amino acid 44 to about amino acid 84. Clone DNA56107-1415 has been deposited with ATCC on Oct. 27, 1998 and is assigned ATCC deposit no. 203405.

An analysis of the Dayhoff database (version 35.45 SwissProt 35), using a WU-BLAST2 sequence alignment analysis of the full-length sequence shown in FIG. 6 (SEQ ID NO:8), evidenced significant homology between the PRO1018 amino acid sequence and the following Dayhoff sequences: CEB0399_4, S59764, YHDT_HAEIN and AE000675_3.

Example 7

Isolation of cDNA Clones Encoding Human PRO1773

A consensus DNA sequence was assembled relative to other EST sequences using phrap as described in Example 1 above. This consensus sequence is herein designated DNA49797. Based upon an observed homology between the DNA49797 consensus sequence and an EST sequence contained within Incyte EST clone no. 509434, Incyte EST clone no. 509434 was purchased and its insert obtained and sequenced. That sequence is herein shown in FIG. 7 and is designated DNA56406-1704.

The entire nucleotide sequence of DNA56406-1704 is shown in FIG. 7 (SEQ ID NO:9). Clone DNA56406-1704 contains a single open reading frame with an apparent translational initiation site at nucleotide positions 111–113 and ending at the stop codon at nucleotide positions 1068–1070 (FIG. 7). The predicted polypeptide precursor is 319 amino acids long (FIG. 8). The fill-length PRO1773 protein shown in FIG. 8 has an estimated molecular weight of about 35,227 daltons and a pI of about 8.97. Analysis of the full-length PRO1773 sequence shown in FIG. 8 (SEQ ID NO:10) evidences the presence of the following: a signal peptide from about amino acid 1 to about amino acid 17, a transmembrane domain from about amino acid 136 to about amino acid 152, potential N-glycosylation sites from about amino acid 161 to about amino acid 164, from about amino acid 187 to about amino acid 190 and from about amino acid 253 to about amino acid 256, a glycosaminoglycan attachment site from about amino acid 39 to about amino acid 42 and potential N-myristolation sites from about amino acid 36 to about amino acid 41, from about amino acid 42 to about amino acid 47, from about amino acid 108 to about amino acid 113, from about amino acid 166 to about amino acid 171, from about amino acid 198 to about amino acid 203 and from about amino acid 207 to about amino acid 212. Clone DNA56406-1704 has been deposited with ATCC on Nov. 17, 1998 and is assigned ATCC deposit no. 203478.

An analysis of the Dayhoff database (version 35.45 SwissProt 35), using a WU-BLAST2 sequence alignment analysis of the full-length sequence shown in FIG. 8 (SEQ ID NO:10), evidenced significant homology between the PRO1773 amino acid sequence and the following Dayhoff sequences: ROH2_RAT, ROH3_RAT, AF030513_1, ROH1_RAT, AF056194_1, AF057034_1, P_W18328, BDH_HUMAN and BDH_RAT.

Example 8

Isolation of cDNA Clones Encoding Human PRO1477

A consensus DNA sequence was assembled relative to other EST sequences using phrap as described in Example 1 above. This consensus sequence is herein designated DNA52641. Based on the DNA52641 consensus sequence, oligonucleotides were synthesized: 1) to identify by PCR a cDNA library that contained the sequence of interest, and 2) for use as probes to isolate a clone of the full-length coding sequence for PRO240.

PCR primers (forward and reverse) were synthesized:
forward PCR primer 5'-CGCCAGAAGGGCGTGATT GACGTC-3' (SEQ ID NO:13)
reverse PCR primer 5'-CCATCCTTCTTCCCAGAC AGGCCG-3' (SEQ ID NO:14)
Additionally, a synthetic oligonucleotide hybridization probe was constructed from the consensus DNA52641 sequence which had the following nucleotide sequence hybridization probe 5'-GAAGCCTGTGTCCAGGTCCT TCAGTGAGTGGTTTGGCCTCGGTC-3' (SEQ ID NO:15)

In order to screen several libraries for a source of a full-length clone, DNA from the libraries was screened by PCR amplification with the PCR primer pair identified above. A positive library was then used to isolate clones encoding the PRO240 gene using the probe oligonucleotide and one of the PCR primers. RNA for construction of the cDNA libraries was isolated from human fetal liver tissue.

DNA sequencing of the clones isolated as described above gave the full-length DNA sequence for PRO1477 (designated herein as DNA56529-1647 [FIG. 9, SEQ ID NO:11]; and the derived protein sequence for PRO1477.

The entire nucleotide sequence of DNA56529-1647 is shown in FIG. 9 (SEQ ID NO:11). Clone DNA56529-1647 contains a single open reading frame with an apparent translational initiation site at nucleotide positions 23–25 and ending at the stop codon at nucleotide positions 2120–2122 (FIG. 9). The predicted polypeptide precursor is 699 amino acids long (FIG. 10). The full-length PRO240 protein shown in FIG. 10 has an estimated molecular weight of about 79,553 daltons and a pI of about 7.83. Analysis of the full-length PRO1477 sequence shown in FIG. 10 (SEQ ID NO:12) evidences the presence of the following: transmembrane domains from about amino acid 21 to about amino acid 40 and from about amino acid 84 to about amino acid 105. Clone DNA56529-1647 has been deposited with ATCC on Sep. 29, 1998 and is assigned ATCC deposit no. 203293.

An analysis of the Dayhoff database (version 35.45 SwissProt 35), using a WU-BLAST2 sequence alignment analysis of the full-length sequence shown in FIG. 10 (SEQ ID NO:12), evidenced significant homology between the PRO1477 amino acid sequence and the following Dayhoff sequences: CELT03G11_1, CEZC410_4, A54408, SSMAN9MAN_1, GEN12643, GEN12642, AF027156_1, P_W46900, SPAC23A1_4 and DMC86E4_5.

Example 9

Isolation of cDNA Clones Encoding Human PRO1478

A consensus DNA sequence was assembled relative to other EST sequences using phrap as described in Example 1 above. This consensus sequence is designated herein "DNA52719". Based on the DNA52719 consensus sequence, oligonucleotides were synthesized: 1) to identify by PCR a cDNA library that contained the sequence of interest, and 2) for use as probes to isolate a clone of the full-length coding sequence for PRO1478.

PCR primers (forward and reverse) were synthesized:
forward PCR primer 5'GCGAACGCTTCGAGGAGTC-CTGG3' (SEQ ID NO:18); and
reverse PCR primer 5'GCAGTGCGGGAAGCCACATGG-TAC3' (SEQ ID NO:19).

Additionally, a synthetic oligonucleotide hybridization probe was constructed from the consensus DNA52719 sequence which had the following nucleotide sequence:
hybridization probe 5'CTTCCTGAGCAGGAAGAA-GATCCGGCACCACATCTACGTGCTCAAC3' (SEQ ID NO:20).

In order to screen several libraries for a source of a full-length clone, DNA from the libraries was screened by PCR amplification with the PCR primer pair identified above. A positive library was then used to isolate clones encoding the PRO1478 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1478 and the derived protein sequence for PRO1478.

The entire coding sequence of PRO1478 is included in FIG. 11 (SEQ ID NO:16). Clone DNA56531-1648 contains a single open reading frame with an apparent translational initiation site at nucleotide positions 77–79 and an apparent stop codon at nucleotide positions 1058–1060 of SEQ ID NO:16. The predicted polypeptide precursor is 327 amino acids long. The type II transmembrane sequence is believed to be at about amino acids 2949 of SEQ ID NO:17, and an N-glycosylation site is believed to be at about amino acids 154–157 of SEQ ID NO:17. Clone DNA56531-1648 has been deposited with ATCC and is assigned ATCC deposit no. 203286. The full-length PRO1478 protein shown in FIG. 12 has an estimated molecular weight of about 37,406 daltons and a pI of about 9.3.

An analysis of the Dayhoff database (version 35.45 SwissProt 35), using a WU-BLAST2 sequence alignment analysis of the full-length sequence shown in FIG. 12 (SEQ ID NO:17), revealed sequence identity between the PRO1478 amino acid sequence and the following Dayhoff sequences: YNJ4_CAEEL, P_R55706, A38781_1, NALS_MOUSE, HUMHGT_1, AF048687_1, CEW02B12_11, Y09F_MYCTU, FOJO_DROME, and G01936.

Example 10

Isolation of cDNA Clones Encoding Human PRO831

DNA56862-1343 was identified by applying the proprietary signal sequence finding algorithm described in Example 3 above. Use of the above described signal sequence algorithm allowed identification of an EST cluster sequence from the Incyte database, designated Incyte cluster sequence no. 25507. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington). The consensus sequence obtained therefrom is herein designated as DNA55714.

In light of the sequence homology between the DNA55714 sequence and an EST sequence contained within the Merck EST clone no. AA099445, the Merck EST clone no. AA099445 was purchased and the cDNA insert was obtained and sequenced. The sequence of this cDNA insert is shown in FIG. 13 and is herein designated as DNA56862-1343.

Clone DNA56862-1343 contains a single open reading frame with an apparent translational initiation site at nucleotide positions 40–42 and ending at the stop codon at nucleotide positions 259–261 (FIG. 13). The predicted polypeptide precursor is 73 amino acids long (FIG. 14). The full-length PRO831 protein shown in FIG. 14 has an estimated molecular weight of about 7,879 daltons and a pI of about 7.21. Analysis of the full-length PRO831 sequence shown in FIG. 14 (SEQ ID NO:22) evidences the presence of the following: a signal peptide from about amino acid 1 to about amino acid 15 and an amino acid sequence block having homology to growth factor and cytokine receptor family proteins from about amino acid 3 to about amino acid 18. Clone DNA56862-1343 has been deposited with ATCC on Sep. 1, 1998 and is assigned ATCC deposit no. 203174.

An analysis of the Dayhoff database (version 35.45 SwissProt 35), using a WU-BLAST2 sequence alignment analysis of the full-length sequence shown in FIG. 14 (SEQ ID NO:22), evidenced significant homology between the PRO831 amino acid sequence and the following Dayhoff sequences: P_W30724, HUMPPA_1, AF022238_1, 4HHB_C, P_R39727, P_R39728, TRYT_MERUN, GPR5_HUMAN, AB010266_3 and HSBCL3S2_1.

Example 11

Isolation of cDNA Clones Encoding Human PRO113

A consensus DNA sequence was assembled relative to other EST sequences using phrap as described in Example 1 above. This consensus sequence is designated herein "DNA34025". Based on the DNA34025 consensus sequence, oligonucleotides were synthesized: 1) to identify by PCR a cDNA library that contained the sequence of interest, and 2) for use as probes to isolate a clone of the full-length coding sequence for PRO1113.

PCR primers (forward and reverse) were synthesized:
forward PCR primer 5'GAGGACTCACCAATCTGGT-TCGGC3' (SEQ ID NO:25); and
reverse PCR primer 5'AACTGGAAAGGAAGGCT-GTCTCCC3' (SEQ ID NO:26).

Additionally, a synthetic oligonucleotide hybridization probe was constructed from the consensus DNA34025 sequence which had the following nucleotide sequence:
hybridization probe 5'GTAAAGGAGAAGAACATCACG-GTACGGGATACCAGGTGTGTTTATCCTAA3' (SEQ ID NO:27).

In order to screen several libraries for a source of a full-length clone, DNA from the libraries was screened by PCR amplification with the PCR primer pair identified above. A positive library was then used to isolate clones encoding the PRO1113 gene using the probe oligonucleotide and one of the PCR primers. RNA for construction of the cDNA libraries was isolated from human fetal kidney.

DNA sequencing of the clones isolated as described above gave the full-length DNA sequence for PRO1113 (designated herein as DNA57254-1477 [FIG. 15, SEQ ID NO:23]; and the derived protein sequence for PRO1113.

The entire coding sequence of PRO1113 is shown in FIG. 15 (SEQ ID NO:23). Clone DNA57254-1477 contains a single open reading frame with an apparent translational initiation site at nucleotide positions 214–216, and an apparent stop codon at nucleotide positions 2062–2064 of SEQ ID NO:23. The predicted polypeptide precursor is 616 amino acids long. The transmembrane domain (type II) is believed to be at about amino acids 13–40 of SEQ ID NO:24. The N-glycosylation sites and N-myristoylation sites are indicated in FIG. 16. Clone DNA57254-1477 has been deposited with the ATCC and is assigned ATCC deposit no. 203289. The full-length PRO1113 protein shown in FIG. 16 has an estimated molecular weight of about 68,243 daltons and a pI of about 8.66.

An analysis of the Dayhoff database (version 35.45 SwissProt 35), using a WU-BLAST2 sequence alignment analysis of the full-length sequence shown in FIG. 16 (SEQ ID NO:24), revealed sequence identity between the PRO113 amino acid sequence and the following Dayhoff sequences (data incorporated herein): D86983_1, A58532, SLIT_DROME, AB007865_1, AC004142_1, CELT21D12_8, AB003184_1, DMU42767_1, MUSLRRP_1 and GPCR_LYMST.

Example 12

Isolation of cDNA Clones Encoding Human PRO1194

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a human pineal gland library. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56511.

In light of the sequence homology between the DNA56511 sequence and an EST contained within the Merck EST AA069568, the clone 382736 which includes this EST was purchased and the cDNA insert was obtained and sequenced. The sequence of this cDNA insert is shown in FIG. 17 and is herein designated as DNA57841-1522.

The full length clone shown in FIG. 17 contained a single open reading frame with an apparent translational initiation site at nucleotide positions 9–11 and ending at the stop codon found at nucleotide positions 252–254 (FIG. 17; SEQ ID NO:28). The predicted polypeptide precursor (FIG. 18, SEQ ID NO:29) is 81 amino acids long. The signal peptide is at about amino acids 1–21 of SEQ ID NO:29. PRO1194 has a calculated molecular weight of approximately 9,223 daltons and an estimated pI of approximately 10.47. Clone DNA57841-1522 was deposited with the ATCC on Nov. 3, 1998 and is assigned ATCC deposit no. 203458.

An analysis of the Dayhoff database (version 35.45 SwissProt 35), using a WU-BLAST2 sequence alignment analysis of the full-length sequence shown in FIG. 18 (SEQ ID NO:29), revealed sequence identity between the PRO1194 amino acid sequence and the following Dayhoff sequences: PT17_YEAST, RR2_CHLVU, CEK12F2_1, S22452, S76705, AF031898_7, A4_DROME, AF038931_1, E49905, and GSPL_AERHY.

Example 13

Isolation of cDNA Clones Encodina Human PRO110

A cDNA clone (DNA58727-1474) encoding a native human PRO1110 polypeptide was identified by a yeast screen, in a human fetal kidney cDNA library that preferentially represents the 5' ends of the primary cDNA clones. The yeast screen employed identified a single EST clone designated herein as DNA45566. The DNA45566 sequence was then compared to various EST databases including public EST databases (e.g., GenBank), and a proprietary EST database (LIFESEQ®, Incyte Pharmaceuticals, Palo Alto, Calif.) to identify homologous EST sequences. The comparison was performed using the computer program BLAST or BLAST2 [Altschul et al., *Methods in Enzymology,* 266:460–480 (1996)]. Those comparisons resulting in a BLAST score of 70 (or in some cases, 90) or greater that did not encode known proteins were clustered and assembled into a consensus DNA sequence with the program "phrap" (Phil Green, University of Washington, Seattle, Wash.). This consensus sequence is herein designated DNA46965. Oligonucleotide primers based upon the DNA46965 sequence were then synthesized and employed to screen a human SK-Lu-1 adenocarcinoma cDNA library (LIB247) which resulted in the identification of the DNA58727-1474 clone shown in FIG. 19.

The full-length DNA58727-1474 clone shown in FIG. 19 contains a single open reading frame with an apparent translational initiation site at nucleotide positions 131–133 and ending at the stop codon at nucleotide positions 1097–1099 (FIG. 19). The predicted polypeptide precursor is 322 amino acids long (FIG. 20). The full-length PRO1110 protein shown in FIG. 20 has an estimated molecular weight of about 35,274 daltons and a pI of about 8.57. Analysis of the full-length PRO1110 sequence shown in FIG. 20 (SEQ ID NO:31) evidences the presence of the following: transmembrane domains from about amino acid 41 to about amino acid 60, from about amino acid 66 to about amino acid 85, from about amino acid 101 to about amino acid 120, from about amino acid 137 to about amino acid 153, from about amino acid 171 to about amino acid 192, from about amino acid 205 to about amino acid 226, from about amino acid 235 to about amino acid 255 and from about amino acid 294 to about amino acid 312, a potential N-glycosylation site from about amino acid 6 to about amino acid 69, and a glycosaminoglycan attachment site from about amino acid 18 to about amino acid 21. Clone DNA58727-1474 has been deposited with ATCC on Sep. 1, 1998 and is assigned ATCC deposit no. 203171.

An analysis of the Dayhoff database (version 35.45 SwissProt 35), using a WU-BLAST2 sequence alignment analysis of the full-length sequence shown in FIG. 20 (SEQ ID NO:31), evidenced significant homology between the PRO1110 amino acid sequence and the following Dayhoff sequences: MMMYELUPR_1, P_R99799, MAL_HUMAN, P_P80929, RNMALGENE_1, S68406, PLLP_RAT, MMMALPROT_1, I38891 and S55622.

Example 14

Isolation of cDNA Clones Encoding Human PRO1378

An initial DNA sequence referred to herein as DNA51941 was identified using a yeast screen, in a human bone marrow cDNA library that preferentially represents the 5' ends of the primary cDNA clones. Based on the DNA51941 sequence, the following oligonucleotides were synthesized for use as probes to isolate a clone of the full-length coding sequence for PRO1377 from a bone marrow cDNA library: TGTCCTTTGTCCCAGACTTCTGTCC (SEQ ID NO:34), CTG-GATGCTAATGTGTCCAGTAAATGATC-CCCTTATCCCGTCGCGATGCT (SEQ ID NO:35); TTCCACTCAATGAGGTGAGCCACTC ( SEQ ID NO:36); GGCGAGCCCTAACTATCCAGGAG (SEQ ID NO:37); GGAGATCGCTGCGCTGGCCAGGTCCTC-CCTGCATGGTAT (SEQ ID NO:38); and CTGCTG-CAAAGCGAGCCTCTTG (SEQ ID NO:39).

The full length DNA58730-1607 clone shown in FIG. 21 contained a single open reading frame with an apparent translational initiation site at nucleotide positions 1365 to 1367 and ending at the stop codon found at nucleotide positions 2370 to 2372 (FIG. 21; SEQ ID NO:32). The predicted polypeptide precursor (FIG. 22, SEQ ID NO:33) is 335 amino acids long, with a signal peptide sequence at about amino acids 1–15. PRO1378 has a calculated molecular weight of approximately 36,108 daltons and an estimated pI of approximately 4.51.

An analysis of the Dayhoff database (version 35.45 SwissProt 35), using a WU-BLAST2 sequence alignment analysis of the full-length sequence shown in FIG. 22 (SEQ ID NO:33), revealed some homology between the PRO1378 amino acid sequence and the following Dayhoff sequences: ICAL_RABIT, SP2_HUMAN, SHPSPRBB_1, SP23_HUMAN, P_W08158, and P_W08150.

Clone DNA58730-1607 was deposited with the ATCC on Sep. 15, 1998, and is assigned ATCC deposit no. 203221.

Example 15

Isolation of cDNA Clones Encoding Human PRO1481

An initial DNA sequence, referred to herein as DNA53254, was identified using a yeast screen, in a human fetal kidney cDNA library that preferentially represents the 5' ends of the primary cDNA clones. Based on the DNA53254 sequence, oligonucleotides were synthesized for use as probes (or primers) to isolate a clone of the full-length coding sequence for PRO1481 from a human fetal kidney cDNA library.

The full length DNA58732-1650 clone shown in FIG. 23 contained a single open reading frame with an apparent translational initiation site at nucleotide positions 320–322 and ending at the stop codon found at nucleotide positions 1322–1324 (FIG. 23; SEQ ID NO:40). The predicted polypeptide precursor (FIG. 24, SEQ ID NO:41) is 334 amino acids long. The signal peptide is at about amino acids 1–23, and a transmembrane domain is at about amino acids 235–262 of SEQ ID NO:41. The N-glycosylation sites are indicated in FIG. 24. PRO1481 has a calculated molecular weight of approximately 36,294 daltons and an estimated pI of approximately 4.98. Clone DNA58732-1650 has been deposited with the ATCC and is assigned ATCC deposit no. 203290.

An analysis of the Dayhoff database (version 35.45 SwissProt 35), using a WU-BLAST2 sequence alignment analysis of the full-length sequence shown in FIG. 24 (SEQ ID NO:41), revealed sequence identity between the PRO1481 amino acid sequence and the following Dayhoff sequences (data incorporated herein): YN23_YEAST, S67770, H36857, YLU2_PICAN, GEN12881, CVY15035_28, YM96_YEAST, ESC1_SCHPO, CELZK783_1 and S59310.

Example 16

Isolation of cDNA Clones Encoding Human PRO1189

A cDNA sequence isolated in the amylase screen described in Example 2 above is herein designated DNA41784. The DNA41784 sequence was then compared to a variety of expressed sequence tag (EST) databases which included public EST databases (e.g., GenBank) and proprietary EST DNA databases (LIFESEQ™, Incyte Pharmaceuticals, Palo Alto, Calif.; and Genentech, South San Francisco, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is herein designated DNA45499.

Based on the DNA45499 sequence, oligonucleotide probes were generated and used to screen a human bone marrow library prepared as described in paragraph 1 of Example 2 above. The cloning vector was pRK5B (pRK5B is a precursor of pRK5D that does not contain the SfiI site; see, Holmes et al., *Science*, 253:1278–1280 (1991)), and the cDNA size cut was less than 2800 bp.

PCR primers (forward and reverse) were synthesized:
forward PCR primer (45499.f1) 5'-GAAAGACACGACACAGCAGCTTGC-3' (SEQ ID NO:44)
forward PCR primer (45499.f2) 5'-GGGAACTGCTATCTGATGCC-3' (SEQ ID NO:45)
forward PCR primer (45499.f3) 5'-CAGGATCTCCTCTTGCAGTCTGCAGC-3' (SEQ ID NO:46)

reverse PCR primer (45499. r1) 5'CTTCTCGAACCACAT-
AAGTTTG AGGCAG-3' (SEQ ID NO:47)
reverse PCR primer (45499. r2) 5'-CACGATTCCCTCC
ACAGCAACTGGG-3' (SEQ ID NO:48).

Additionally, a synthetic oligonucleotide hybridization probe was constructed from the DNA45499 sequence which had the following nucleotide sequence:
hybridization probe (45499.p1) 5'-CGCCTTACCGCG CAGCCCGAAGATTCACTATGGTGAAAATCGCC TTCAAT-3' (SEQ ID NO:230).

In order to screen several libraries for a source of a full-length clone, DNA from the libraries was screened by PCR amplification with the PCR primer pair identified above. A positive library was then used to isolate clones encoding the PRO1189 gene using the probe oligonucleotide and one of the PCR primers.

A full length clone was identified that contained a single open reading frame with an apparent translational initiation site at nucleotide positions 79–81, and a stop signal at nucleotide positions 868–870 (FIG. 25; SEQ ID NO:42). The predicted polypeptide precursor is 263 amino acids long has a calculated molecular weight of approximately 29,741 daltons and an estimated pI of approximately 5.74. Additional features include a type II transmembrane domain at about amino acids 53–75 and a potential N-glycosylation site at about amino acids 166–169.

An analysis of the Dayhoff database (version 35.45 SwissProt 35), using a WU-BLAST2 sequence alignment analysis of the full-length sequence shown in FIG. 26 (SEQ ID NO:43), evidenced significant homology between the PRO1189 amino acid sequence and Dayhoff sequences MUSE25A_1 and HS696H22_1. Additionally, some homology was revealed between the PRO1189 amino acid sequence and the following Dayhoff sequences: AF017985_1, CBRG01D9_2, I79662, and CHPDRBAG_1.

Clone DNA58828-1519 has been deposited with ATCC and is assigned ATCC deposit no. 203172.

Example 17

Isolation of cDNA Clones Encoding Human PRO1415

Use of the signal sequence algorithm described in Example 3 above allowed identification of an EST cluster sequence from the Incyte database, designated Incyte EST cluster sequence no. 150918. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA55720.

In light of the sequence homology between the DNA55720 sequence and an EST sequence contained within the Incyte EST clone no. 4081476, the Incyte EST clone no. 4081476 was purchased and the cDNA insert was obtained and sequenced. The sequence of this cDNA insert is shown in FIG. 27 and is herein designated as DNA58852-1637.

Clone DNA58852-1637 contains a single open reading frame with an apparent translational initiation site at nucleotide positions 148–150 and ending at the stop codon at nucleotide positions 997–999 (FIG. 27). The predicted polypeptide precursor is 283 amino acids long (FIG. 28). The full-length PRO1415 protein shown in FIG. 28 has an estimated molecular weight of about 29,191 daltons and a pI of about 4.52. Analysis of the full-length PRO1415 sequence shown in FIG. 28 (SEQ ID NO:50) evidences the presence of the following: a signal peptide from about amino acid 1 to about amino acid 25, a transmembrane domain from about amino acid 94 to about amino acid 118 and potential N-myristolation sites from about amino acid 18 to about amino acid 23, from about amino acid 40 to about amino acid 45, from about amino acid 46 to about amino acid 51, from about amino acid 145 to about amino acid 150, from about amino acid 192 to about amino acid 197, from about amino acid 193 to about amino acid 198, from about amino acid 211 to about amino acid 216, from about amino acid 238 to about amino acid 243 and from about amino acid 242 to about amino acid 247. Clone DNA58852-1637 has been deposited with ATCC on Sep. 22, 1998 and is assigned ATCC deposit no. 203271.

An analysis of the Dayhoff database (version 35.45 SwissProt 35), using a WU-BLAST2 sequence alignment analysis of the full-length sequence shown in FIG. 28 (SEQ ID NO:50), evidenced significant homology between the PRO1415 amino acid sequence and the following Dayhoff sequences: HSU66616_1, P_W24017, A38219, CD30_HUMAN, HSU78971_1, P_W22214, NFM_HUMAN, ADH1_ASPFL, PAU93274_5 and CENB_MOUSE.

Example 18

Isolation of cDNA Clones Encoding Human PRO1411

Use of the signal sequence algorithm described in Example 3 above allowed identification of an EST cluster sequence from an Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs were derived from a thryroid tissue library. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56013.

In light of the sequence homology between the DNA56013 sequence and an EST sequence contained within the Incyte EST 1444225, the clone including this EST was purchased and the cDNA insert was obtained and sequenced. The sequence of this cDNA insert is shown in FIG. 29 and is herein designated as DNA59212-1627.

The full length clone shown in FIG. 29 contained a single open reading frame with an apparent translational initiation site at nucleotide positions 184–186 and ending at the stop codon found at nucleotide positions 1504–1506 (FIG. 29; SEQ ID NO:51). The predicted polypeptide precursor (FIG. 30, SEQ ID NO:52) is 440 amino acids long. The signal peptide is at about amino acids 1–21, and the cell attachment site is at about amino acids 301–303 of SEQ ID NO:52. PRO1411 has a calculated molecular weight of approximately 42,208 daltons and an estimated pI of approximately 6.36. Clone DNA59212-1627 was deposited with the ATCC on Sep. 9, 1998 and is assigned ATCC deposit no. 203245.

An analysis of the Dayhoff database (version 35.45 SwissProt 35), using a WU-BLAST2 sequence alignment analysis of the full-length sequence shown in FIG. 30 (SEQ ID NO:52), revealed sequence identity between the PRO1411 amino acid sequence and the following Dayhoff sequences (data from database incorporated herein): MTV023_19, P_R05307, P_W26348, P_P82962, AF000949_1, EBN1_EBV, P_R95107, GRP2_PHAVU, P_R81318, and S74439_1.

Example 19

Isolation of cDNA Clones Encoding Human PRO1295

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a thymus tissue library. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56262.

In light of the sequence homology between the DNA56262 sequence and an EST contained within the Incyte EST 3743334, the clone including this EST was purchased and the cDNA insert was obtained and sequenced. The sequence of this cDNA insert is shown in FIG. 31 and is herein designated as DNA59218-1559.

The full length clone shown in FIG. 31 contained a single open reading frame with an apparent translational initiation site at nucleotide positions 207–209 and ending at the stop codon found at nucleotide positions 1047–1049 (FIG. 31; SEQ ID NO:53). The predicted polypeptide precursor (FIG. 32, SEQ ID NO:54) is 280 amino acids long. The signal peptide is at about amino acids 1–18 of SEQ ID NO:54. A targeting signal and N-glycosylation site are also indicated in FIG. 54. PRO1295 has a calculated molecular weight of approximately 30,163 daltons and an estimated pI of approximately 6.87. Clone DNA59218-1559 was deposited with the ATCC on Sep. 29, 1998 and is assigned ATCC deposit no. 203287.

An analysis of the Dayhoff database (version 35.45 SwissProt 35), using a WU-BLAST2 sequence alignment analysis of the full-length sequence shown in FIG. 32 (SEQ ID NO:54), revealed sequence identity between the PRO1295 amino acid sequence and the following Dayhoff sequences (data incorporated herein): AB011099_1, ILVE_MYCTU, ATTECR_2, AF010496_27, P_R15346, S37191, PER_DROMS, L2MU_ADECC and P_W34238.

Example 20

Isolation of cDNA Clones Encoding Human PRO1359

Use of the signal sequence algorithm described in Example 3 above allowed identification of an EST cluster sequence from an Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a sigmoid colon tissue library. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56263.

In light of the sequence homology between the DNA56263 sequence and the Incyte EST 1931418, the clone including this EST was purchased and the cDNA insert was obtained and sequenced. The sequence of this cDNA insert is shown in FIG. 33 and is herein designated as DNA59219-1613.

The full length clone shown in FIG. 33 contained a single open reading frame with an apparent translational initiation site at nucleotide positions 184–186 and ending at the stop codon found at nucleotide positions 1081–1083 (FIG. 33; SEQ ID NO:55). The predicted polypeptide precursor (FIG. 34, SEQ ID NO:56) is 299 amino acids long. The transmembrane domain is at about amino acids 9–31 of SEQ ID NO:56. N-gylcosylation sites are at about amino acids 64–67 and 115–118 of SEQ ID NO:56. PRO1359 has a calculated molecular weight of approximately 34,291 daltons and an estimated pI of approximately 9.87. Clone DNA59219-1613 was deposited with the ATCC on Sep. 15, 1998 and is assigned ATCC deposit no. 203220.

An analysis of the Dayhoff database (version 35.45 SwissProt 35), using a WU-BLAST2 sequence alignment analysis of the full-length sequence shown in FIG. 34 (SEQ ID NO:56), revealed sequence identity between the PRO1359 amino acid sequence and the following Dayhoff sequences (data incorporated herein): GEM14384, P_R78622, A23699_1, P_R65244, A54898, AF059321_1, RNU55938_1, BTRNAST6_1, P_R75199 and P_R63216.

Example 21

Isolation of cDNA Clones Encoding Human PRO1190

The method described in Example 1 above allowed the identification of a single Merck/Washington University EST sequence, EST no. AA339802, which is designated herein as "DNA53943". Based on the DNA53943 sequence, oligonucleotides were synthesized: 1) to identify by PCR a cDNA library that contained the sequence of interest, and 2) for use as probes to isolate a clone of the full-length coding sequence for PRO1190.

PCR primers (forward and reverse) were synthesized:
forward PCR primer: (53943. f1) GGGAAACACAG-CAGTCATTGCCTGC (SEQ ID NO:59)
reverse PCR primer: (53943. r1) GCACACGTAGCCT-GTCGCTGGAGC (SEQ ID NO:60)

Additionally, a synthetic oligonucleotide hybridization probe was constructed from the DNA53943 sequence which had the following nucleotide sequence:
hybridization probe: (53943.p1) CACCCCAAAGCCCAG-GTCCGGTACAGCGTCAAACAAGAGTGG (SEQ ID NO:61)

In order to screen several libraries for a source of a full-length clone, DNA from the libraries was screened by PCR amplification with the PCR primer pair identified above. A positive library was then used to isolate clones encoding the PRO1190 gene using the probe oligonucleotide and one of the PCR primers. RNA for construction of the cDNA libraries was isolated from human bone marrow.

DNA sequencing of the clones isolated as described above gave the full-length DNA sequence for PRO1190 (designated herein as DNA59586-1520 [FIG. 35, SEQ ID NO:57]; and the derived protein sequence for PRO1190.

The entire coding sequence of PRO1190 is shown in FIG. 35 (SEQ ID NO:57). Clone DNA59586-1520 contains a single open reading frame with an apparent translational initiation site at nucleotide positions 340–342 and an apparent stop codon at nucleotide positions 3685–3687. The predicted polypeptide precursor is 1115 amino acids long. The full-length PRO1190 protein shown in FIG. 36 has an estimated molecular weight of about 121,188 daltons and a pI of about 7.07. Other features of the PRO1190 protein include: two transmembrane domains at amino acids 16–30 and 854–879; a cytochrome P450 cystein heme-iron ligand signature at amino acids 1051–1060; an N-6 adenine-specific DNA methylases signature at amino acids 1045–1051; and potential N-glycosylation sites at amino acids 65–68, 76–79, 98–101, 189–192, 275–278, 518–521, 726–729, and 760–763. Clone DNA59586-1520 was deposited with the ATCC on Sep. 29, 1998, and is assigned ATCC deposit no. 203288.

An analysis of the Dayhoff database (version 35.45 SwissProt 35), using a WU-BLAST2 sequence alignment analysis of the full-length sequence shown in FIG. 36 (SEQ ID NO:58), revealed homology between the PRO1190 amino acid sequence and the following Dayhoff sequences: AF004840_1, AF004841_1, AF026465_1, HSU72391_1, P_R13144, AXO1_HUMAN, GEN13349, I58164, D87212_1, A53449, and D86983_1, and KIAA0230.

Example 22

Isolation of cDNA Clones Encoding Human PRO1772

A consensus DNA sequence was assembled relative to other EST sequences using phrap as described in Example 1 above. This consensus sequence is herein designated DNA45120. Based on the DNA45120 consensus sequence, oligonucleotides were synthesized: 1) to identify by PCR a cDNA library that contained the sequence of interest, and 2) for use as probes to isolate a clone of the full-length coding sequence for PRO1772.

PCR primers (forward and reverse) were synthesized:
forward PCR primer (45120.f1) 5'-CCTTCACCTGCAGTACACCATGGGC-3' (SEQ ID NO:64)
reverse PCR primer (45120.r1) 5'-GTCACACACAGCTCTGGCAGCTGAG-3' (SEQ ID NO:65)
Additionally, a synthetic oligonucleotide hybridization probe was constructed from the consensus DNA45120 sequence which had the following nucleotide sequence hybridization probe (45120.p1) 5'-CCAAGTTCAGACAC CACATGTACACCAACGTCAGCGGATTGACAAGC-3' (SEQ ID NO:66)

RNA for construction of the cDNA libraries was isolated from human bone marrow tissue.

DNA sequencing of the clones isolated as described above gave the full-length DNA sequence for PRO1772 (designated herein as DNA59817-1703 [FIG. 37, SEQ ID NO:62]; and the derived protein sequence for PRO1772.

The entire nucleotide sequence of DNA59817-1703 is shown in FIG. 37 (SEQ ID NO:62). Clone DNA59817-1703 contains a single open reading frame with an apparent translational initiation site at nucleotide positions 93–95 and ending at the stop codon at nucleotide positions 1554–1556 (FIG. 37). The predicted polypeptide precursor is 487 amino acids long (FIG. 38). The full-length PRO1772 protein shown in FIG. 38 has an estimated molecular weight of about 53,569 daltons and a pI of about 7.68. Analysis of the full-length PRO1772 sequence shown in FIG. 38 (SEQ ID NO:63) evidences the presence of the following: a signal peptide from about amino acid 1 to about amino acid 36, a transmembrane domain from about amino acid 313 to about amino acid 331, potential N-glycosylation sites from about amino acid 119 to about amino acid 122, from about amino acid 184 to about amino acid 187, from about amino acid 243 to about amino acid 246 and from about amino acid 333 to about amino acid 336, potential N-myristolation sites from about amino acid 41 to about amino acid 46, from about amino acid 59 to about amino acid 64, from about amino acid 73 to about amino acid 78, from about amino acid 133 to about amino acid 138, from about amino acid 182 to about amino acid 187, from about amino acid 194 to about amino acid 199, from about amino acid 324 to about amino acid 329, from about amino acid 354 to about amino acid 359, from about amino acid 357 to about amino acid 362, from about amino acid 394 to about amino acid 399, from about amino acid 427 to about amino acid 432 and from about amino acid 472 to about amino acid 477 and a prokaryotic membrane lipoprotein lipid attachment site from about amino acid 136 to about amino acid 146. Clone DNA59817-1703 has been deposited with ATCC on Nov. 17, 1998 and is assigned ATCC deposit no. 203470.

An analysis of the Dayhoff database (version 35.45 SwissProt 35), using a WU-BLAST2 sequence alignment analysis of the full-length sequence shown in FIG. 38 (SEQ ID NO:63), evidenced significant homology between the PRO1772 amino acid sequence and the following Dayhoff sequences: P_R30823, MDP1_PIG, MDP1_HUMAN, P_R13857, P_R53920, MDP1_MOUSE, P_R30822, JC4222, CELF52C6_2 and MYV027_13.

Example 23

Isolation of cDNA Clones Encoding Human PRO1248

Use of the signal sequence algorithm described in Example 3 above allowed identification of an EST cluster sequence from the Incyte database, designated Incyte EST cluster sequence no. 7494. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56056.

In light of the sequence homology between the DNA56056 sequence and an EST contained within the Merck EST clone no. AA404441, the Merck EST clone no. AA404441 was purchased and the cDNA insert was obtained and sequenced. The sequence of this cDNA insert is shown in FIG. 39 and is herein designated as DNA60278-1530.

Clone DNA60278-1530 contains a single open reading frame with an apparent translational initiation site at nucleotide positions 122–124 and ending at the stop codon at nucleotide positions 671–673 (FIG. 39). The predicted polypeptide precursor is 183 amino acids long (FIG. 40). The full-length PRO1248 protein shown in FIG. 40 has an estimated molecular weight of about 20,574 daltons and a pI of about 6.60. Analysis of the full-length PRO1248 sequence shown in FIG. 40 (SEQ ID NO:68) evidences the presence of the following: a signal peptide from about amino acid 1 to about amino acid 20, a transmembrane domain from about amino acid 90 to about amino acid 112 and potential N-glycosylation sites from about amino acid 21 to about amino acid 24, from about amino acid 38 to about amino acid 41 and from about amino acid 47 to about amino acid 50. Clone DNA60278-1530 has been deposited with ATCC on Sep. 1, 1998 and is assigned ATCC deposit no. 203170.

An analysis of the Dayhoff database (version 35.45 SwissProt 35), using a WU-BLAST2 sequence alignment analysis of the full-length sequence shown in FIG. 40 (SEQ ID NO:68), evidenced significant homology between the PRO1248 amino acid sequence and the following Dayhoff sequences: AF026198_5, CELR12C12_5, PN0563, S64541_1, PN0564, P_R44881 and XLU78189_1.

Example 24

Isolation of cDNA Clones Encoding Human PRO1316

The extracellular domain (ECD) which includes the signal sequence, if any, of publicly available databases known to contain secreted sequences were used to search various publicly available EST (Expressed Sequenced Tag) databases (GenBank, Merck/Wash. U). The search was performed using the computer program BLAST or BLAST2 [Altschul et al., Methods in Enzymology 266: 460–480 (1996)] as a comparison of the ECD protein sequences to a 6 frame translation of the EST sequences. Those comparisons resulting in a BLAST score of 70 (or in some cases 90) or greater that did not did not encode known proteins were clustered and assembled into consensus DNA sequences with the program "phrap" (Phil Green, University of Washington, Seattle, Wash.).

The above search resulted in the identification of the EST, designated W55979 which showed homology with the secreted protein Dkk-1. The clone corresponding to EST W55979 (clone NbHH19W) was purchased from Merck/Washington University and the cDNA insert was obtained and sequenced in its entirety.

The nucleic acid sequence corresponding to the full length PRO1316 (designated DNA60608-1577) encoded by the purchased clone, is shown in FIG. 41 (SEQ ID NO:69). DNA60608-1577 contains a single open reading frame with an apparent translational initiation site at nucleotide positions 211–213, and a stop codon at nucleotide positions 988–990 (FIG. 42; SEQ ID NO:70). The predicted polypeptide precursor is 259 amino acids long. Additional regions of significant interest include the nucleotide residues encoding the signal peptide (211–283), an N-glycosylation site (364–366), and the Zn(2)-Cys(6) binuclear cluster domain (505–655). Clone DNA60608-1577 has been deposited with ATCC and is assigned ATCC deposit no. 203126. The full-length PRO1316 protein shown in FIG. 42 has an estimated molecular weight of about 28,447 daltons and a pI of about 9.48.

Based on a BLAST and FastA sequence alignment analysis (using the ALIGN computer program) of the full-length sequence, PRO1316 shows significant amino acid sequence identity to the dickkopf family of proteins. Additionally, DNA60608 has shown homology to AF030433_1, LFE4_CHICK, COL_RABIT, YQI6_CAEEL, ITB6_HUMAN, CONO_LYMST, S41033, D63483_1, D86864_1 and AB001978_1.

Example 25

Isolation of cDNA Clones Encoding Human PRO1197

An initial DNA sequence, referred to herein as DNA56267, was identified using a yeast screen, in a human SK-Lu-1 adenocarcinoma cDNA library that preferentially represents the 5' ends of the primary cDNA clones. DNA56267 was used to synthesize oligonucleotides for use as probes to isolate a clone of the full-length coding sequence for PRO1197 from a human breast carcinoma cDNA library.

SEQ ID NO:73: 5'AATTCATGGCAAATATTTCCCT-TCCC3' (forward);

SEQ ID NO:74: 5'TGGTAAACTGGCCCAAACTCGG3' (reverse); and

SEQ ID NO:75: 5'TTAAAGTCATCCGTCCTTGGCT-CAGGATTTGGAGAGCTTGCACCACCAAA3' (probe).

The full length DNA60611-1524 clone shown in FIG. 43 contained a single open reading frame with an apparent translational initiation site at nucleotide positions 311–313 and ending at the stop codon found at nucleotide positions 1400–1402 (FIG. 43; SEQ ID NO:71). The predicted polypeptide precursor (FIG. 44, SEQ ID NO:72) is 363 amino acids long. The signal peptide is at about amino acids 1–24 of SEQ ID NO:72. PRO1197 has a calculated molecular weight of approximately 38,825 daltons and an estimated pI of approximately 9.88. Clone DNA60611-1524 has been deposited with ATCC and is assigned ATCC deposit no. 203175.

An analysis of the Dayhoff database (version 35.45 SwissProt 35), using a WU-BLAST2 sequence alignment analysis of the full-length sequence shown in FIG. 44 (SEQ ID NO:72), revealed sequence identity between the PRO1197 amino acid sequence and the following Dayhoff sequences (information from database incorporated herein): Y144_HUMAN, I47141 (a gastric mucin, mucins are described in *Ann. NY Acad. Sci.,* 140(2):804–834 (1967), AMYH_YEAST, CELK06A9_3, CELZK783_1, HKR1_YEAST, AB003521_1, D87895_1, S61993 and YM96_YEAST.

Example 26

Isolation of cDNA Clones Encoding Human PRO1293

Use of the signal sequence algorithm described in Example 3 above allowed identification of an EST cluster sequence from the Incyte database, designated Incyte EST cluster sequence no. 115204. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56522.

In light of the sequence homology between the DNA56522 sequence and an EST contained within the Incyte EST clone no. 2966119, the Incyte EST clone no. 2966119 was purchased and the cDNA insert was obtained and sequenced. The sequence of this cDNA insert is shown in FIG. 45 and is herein designated as DNA60618-1557.

Clone DNA60618-1557 contains a single open reading frame with an apparent translational initiation site at nucleotide positions 37–39 and ending at the stop codon at nucleotide positions 1060–1062 (FIG. 45). The predicted polypeptide precursor is 341 amino acids long (FIG. 46). The full-length PRO1293 protein shown in FIG. 46 has an estimated molecular weight of about 38,070 daltons and a pI of about 6.88. Analysis of the full-length PRO1293 sequence shown in FIG. 46 (SEQ ID NO:77) evidences the presence of the following: a signal peptide from about amino acid 1 to about amino acid 19, a transmembrane domain from about amino acid 237 to about amino acid 262, a potential N-glycosylation site from about amino acid 205 to about amino acid 208, a cell attachment sequence from about amino acid 151 to about amino acid 152 and an amino acid sequence block having homology to coproporphyrinogen III oxidase proteins from about amino acid 115 to about amino acid 140. Clone DNA60618-1557 has been deposited with ATCC on Sep. 29, 1998 and is assigned ATCC deposit no. 203292.

An analysis of the Dayhoff database (version 35.45 SwissProt 35), using a WU-BLAST2 sequence alignment analysis of the full-length sequence shown in FIG. 46 (SEQ ID NO:77), evidenced significant homology between the PRO1293 amino acid sequence and the following Dayhoff sequences: HSVCD54_1, A33_HUMAN, AF009220_1, HSU82279_1, AF004230_1, P_R13272, AF004231_1, AF043644_1, S44125 and HSIGGHC85_1.

Example 27

Isolation of cDNA Clones Encoding Human PRO1380

A cDNA sequence isolated in the amylase screen described in Example 2 above is herein designated DNA45776. Based on the DNA45776 sequence, oligonucleotide probes were generated and used to screen a human retina library prepared as described in paragraph 1 of Example 2 above. The cloning vector was pRK5B (pRK5B is a precursor of pRK5D that does not contain the SfiI site; see, Holmes et al., *Science,* 253:1278–1280 (1991)), and the cDNA size cut was less than 2800 bp.

PCR primers (forward and reverse) were synthesized:
forward PCR primer (45776.f1) 5'-TTTTGCGGTCACCATTGTCTGC-3' (SEQ ID NO:80) and
reverse PCR primer (45776.r1) 5'-CGTAGGTGACACAGAAGCCCAGG-3' (SEQ ID NO:81).

Additionally, a synthetic oligonucleotide hybridization probe was constructed from the DNA45776 sequence which had the following nucleotide sequence:
hybridization probe (45776.p1) 5'-TACGGCATG ACCG-GCTCCTTTCCTATGAGGAACTCCCAGGCAC TGATAT-3' (SEQ ID NO:82).

In order to screen several libraries for a source of a full-length clone, DNA from the libraries was screened by PCR amplification with the PCR primer pair identified above. A positive library was then used to isolate clones encoding the PRO1380 gene using the probe oligonucleotide and one of the PCR primers.

A full length clone was identified that contained a single open reading frame with an apparent translational initiation site at nucleotide positions 36–38, and a stop signal at nucleotide positions 1461–1463 (FIG. 47; SEQ ID NO:78). The predicted polypeptide precursor is 470 amino acids long has a calculated molecular weight of approximately 51,715 daltons and an estimated pI of approximately 7.86. Additional features include transmembrane domains at about amino acids 50–74, 105–127, 135–153, 163–183, 228–252, 305–330, and 448–472; potential N-glycosylation sites at about amino acids 14–17 and 84–87; and a dihydrofolate reductase signature at about amino acids 60–68.

An analysis of the Dayhoff database (version 35.45 SwissProt 35), using a WU-BLAST2 sequence alignment analysis of the full-length sequence shown in FIG. 48 (SEQ ID NO:79), evidenced homology between the PRO1380 amino acid sequence and the following Dayhoff sequences: HSU81375_1, CEZK809_6, CEK02E11_1, AF034102_1, JC4196, CEF36H2_2, P_R92315, YAC2_YEAST, F1707_13, and CEF44D12_3.

Clone DNA60740-1615 was deposited with the ATCC on Nov. 3, 1998, and is assigned ATCC deposit no. 203456.

Example 28

Isolation of cDNA Clones Encoding Human PRO1265

Use of the signal sequence algorithm described in Example 3 above allowed identification of an EST cluster sequence from the LIFESEQ® database, designated EST Cluster No. 86995. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). One or more of the ESTs used in the assembly was derived from a cDNA library prepared from RNA isolated from inflamed human adenoid tissue. The consensus sequence obtained therefrom is herein designated DNA55717.

In light of the sequence homology between the DNA55717 sequence and an EST sequence contained within Incyte EST no. 20965, EST clone no. 20965 was purchased and the cDNA insert was obtained and sequenced. The sequence of this cDNA insert is shown in FIG. 49 and is herein designated as DNA60764.

The full length clone shown in FIG. 49 contained a single open reading frame with an apparent translational initiation site at nucleotide positions 79–81 and ending at the stop codon found at nucleotide positions 1780–1782 (FIG. 49; SEQ ID NO:83). The predicted polypeptide precursor (FIG. 50, SEQ ID NO:84) is 567 amino acids long. PRO1265 has a calculated molecular weight of approximately 62,881 daltons and an estimated pI of approximately 8.97. Additional features include a signal peptide sequence at about amino acids 1–21; potential N-glycosylation sites at about amino acids 54–57, 134–137, 220–223, and 559–562; and a region having amino acid sequence identity with D-amino acid oxidase proteins at about amino acids 61–80.

An analysis of the Dayhoff database (version 35.45 SwissProt 35), using a WU-BLAST2 sequence alignment analysis of the full-length sequence shown in FIG. 50 (SEQ ID NO:84), revealed significant sequence identity between the PRO1265 amino acid sequence and Dayhoff sequence no. MMU70429_1. Sequence homology was also found to exist between the full-length sequence shown in FIG. 50 (SEQ ID NO:84) and the following additional Dayhoff sequences: BC542A_1, E69899, S76290, MTV014_14, AOFB_HUMAN, ZMJ002204_1, S45812_1, DBRNAPD_1, and CRT1_SOYBN.

Clone DNA60764-1533 was deposited with the ATCC on Nov. 10, 1998, and is assigned ATCC deposit no. 203452.

Example 29

Isolation of cDNA Clones Encoding Human PRO1250

Use of the signal sequence algorithm described in Example 3 above allowed identification of an EST cluster sequence from the Incyte database, designated Incyte EST cluster sequence no. 56523. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56103.

In light of the sequence homology between the DNA56103 sequence and an EST sequence contained within the Incyte EST clone no. 3371784, the Incyte EST clone no. 3371784 was purchased and the cDNA insert was obtained and sequenced. The sequence of this cDNA insert is shown in FIG. 51 and is herein designated as DNA60775-1532.

Clone DNA60775-1532 contains a single open reading frame with an apparent translational initiation site at nucleotide positions 74–76 and ending at the stop codon at nucleotide positions 2291–2293 (FIG. 51). The predicted polypeptide precursor is 739 amino acids long (FIG. 52). The full-length PRO1250 protein shown in FIG. 52 has an estimated molecular weight of about 82,263 daltons and a pI of about 7.55. Analysis of the full-length PRO1250 sequence shown in FIG. 52 (SEQ ID NO:86) evidences the presence of the following: a type II transmembrane domain from about amino acid 61 to about amino acid 80, a putative AMP-binding domain signature sequence from about amino acid 314 to about amino acid 325, and potential N-glycosylation sites from about amino acid 102 to about amino acid 105, from about amino acid 588 to about amino acid 591 and from about amino acid 619 to about amino acid 622. Clone DNA60775-1532 has been deposited with ATCC on Sep. 1, 1998 and is assigned ATCC deposit no. 203173.

An analysis of the Dayhoff database (version 35.45 SwissProt 35), using a WU-BLAST2 sequence alignment analysis of the full-length sequence shown in FIG. 52 (SEQ ID NO:86), evidenced significant homology between the PRO1250 amino acid sequence and the following Dayhoff sequences: LCFB_HUMAN, S56508_1, BNAMPBP2_1, BNACS7_1, CELT08B1_6, CELC46F4_2, AF008206_6, CELR07C3_11, LMU70253_2 and AF008206_7.

Example 30

Isolation of cDNA Clones Encoding Human PRO1475

A consensus DNA sequence was assembled relative to other EST sequences using phrap as described in Example 1 above. This consensus sequence is herein designated DNA45639. Based on the DNA45639 consensus sequence, oligonucleotides were synthesized: 1) to identify by PCR a cDNA library that contained the sequence of interest, and 2) for use as probes to isolate a clone of the full-length coding sequence for PRO1475.

PCR primers (forward and reverse) were synthesized:
forward PCR primer (45639.f1)
5'-GATGGCAAAACGTGTGTTTGACACG-3' (SEQ ID NO:89)
forward PCR primer (45639.f2)
5'-CCTCAACCAGGCCACGGGCCAC-3' (SEQ ID NO:90)
reverse PCR primer (45639.r1)
5'-CCCAGGCAGAGATGCAGTACAGGC-3' (SEQ ID NO:91)
reverse PCR primer (45639.r2)
5'-CCTCCAGTAGGTGGATGGATTGGCTC-3' (SEQ ID NO:92)
Additionally, a synthetic oligonucleotide hybridization probe was constructed from the consensus DNA45639 sequence which had the following nucleotide sequence
hybridization probe (45639.p1)
5'-CTCACCTCATGAGGATGAGGCCATGGTGCTAT TCCTCAACATGGTAG-3' (SEQ ID NO:93)

In order to screen several libraries for a source of a full-length clone, DNA from the libraries was screened by PCR amplification with the PCR primer pair identified above. A positive library was then used to isolate clones encoding the PRO1475 gene using the probe oligonucleotide and one of the PCR primers. RNA for construction of the cDNA libraries was isolated from human fetal brain tissue.

DNA sequencing of the clones isolated as described above gave the full-length DNA sequence for PRO1475 (designated herein as DNA61185-1646 [FIG. 53, SEQ ID NO:87]; and the derived protein sequence for PRO1475.

The entire nucleotide sequence of DNA61185-1646 is shown in FIG. 53 (SEQ ID NO:87). Clone DNA61185-1646 contains a single open reading frame with an apparent translational initiation site at nucleotide positions 130–132 and ending at the stop codon at nucleotide positions 2110–2112 (FIG. 53). The predicted polypeptide precursor is 660 amino acids long (FIG. 54). The full-length PRO1475 protein shown in FIG. 54 has an estimated molecular weight of about 75,220 daltons and a pI of about 6.76. Analysis of the full-length PRO1475 sequence shown in FIG. 54 (SEQ ID NO:88) evidences the presence of the following: a transmembrane domain from about amino acid 38 to about amino acid 55 and a homologous region to mouse GNT1 from about amino acid 229 to about amino acid 660. Clone DNA61185-1646 has been deposited with ATCC on Nov. 17, 1998 and is assigned ATCC deposit no. 203464.

An analysis of the Dayhoff database (version 35.45 SwissProt 35), using a WU-BLAST2 sequence alignment analysis of the full-length sequence shown in FIG. 54 (SEQ ID NO:88), evidenced significant homology between the PRO1475 amino acid sequence and the following Dayhoff sequences: GNT1_MOUSE, CGU65792_1, CGU65791_1, P_R24781, CELF48E3_1, G786_HUMAN, P_W06547, GNT1_CAEEL, 219_HUMAN and EF07_MOUSE.

Example 31

Isolation of cDNA Clones Encoding Human PRO1377

An initial DNA sequence, referred to herein as DNA46892, was identified using a yeast screen, in a human umbilical vein endothelial cell cDNA library that preferentially represents the 5' ends of the primary cDNA clones. Based on the DNA46892 sequence, the following oligonucleotides were synthesized for use as probes to isolate a clone of the full-length coding sequence for PRO1377 from a human fetal kidney cDNA library: GTTGTGGGT-GAATAAAGGAGGGCAG (SEQ ID NO:96), CTGTGCT-CATGTTCATGGACAACTG (SEQ ID NO:97), and GGAT-GATTTCATCTCCATTAGCCTGCTGTCTCTGGCTATG TTGGTGGGAT (SEQ ID NO:98).

The full length DNA61608-1606 clone shown in FIG. 55 contained a single open reading frame with an apparent translational initiation site at nucleotide positions 149–151 and ending at the stop codon found at nucleotide positions 1070–1072 (FIG. 55; SEQ ID NO:94). The predicted polypeptide precursor (FIG. 56, SEQ ID NO:95) is 307 amino acids long. PRO1377 has a calculated molecular weight of approximately 32,251 daltons and an estimated pI of approximately 6.62. Additional features include: a signal peptide at about amino acids 1–18; potential N-glycosylation sites at about amino acids 29–32 and 241–244, and transmembrane domains at about amino acids 37–56, 106–122, 211–230, 240–260, and 288–304.

An analysis of the Dayhoff database (version 35.45 SwissProt 35), using a WU-BLAST2 sequence alignment analysis of the full-length sequence shown in FIG. 56 (SEQ ID NO:95), revealed some homology between the PRO1377 amino acid sequence and the following Dayhoff sequences: CET01D3_6, CET28F3_4, CEF26D10_3, S66962, ATX2_YEAST, CEH13N06_8, S49959, YIC3_YEAST, G02273, and P_W35557.

Clone DNA61608-1606 has been deposited with ATCC and is assigned ATCC deposit no. 203239.

Example 32

Isolation of cDNA Clones Encoding Human PRO1326

Use of the signal sequence algorithm described in Example 3 above allowed identification of an EST cluster sequence from the LIFESEQ® database, designated Incyte Cluster No. 59366, also referred herein as "DNA10295". This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). One or more of the ESTs was derived from RNA isolated from tumor tissue removed from the penis of a male with squamous cell carcinoma. The consensus sequence obtained therefrom is herein designated DNA56257.

In light of the sequence homology between the DNA56257 sequence and an EST sequence contained within Incyte EST no. 1450878, the EST clone 1450878 was purchased and the cDNA insert was obtained and sequenced in its entirety. The sequence of this cDNA insert is shown in FIG. 57 and is herein designated as "DNA62808-1582".

The full length clone shown in FIG. 57 contained a single open reading frame with an apparent translational initiation site at nucleotide positions 112 to 114 and ending at the stop codon found at nucleotide positions 1315 to 1317 (FIG. 57; SEQ ID NO:99). The predicted polypeptide precursor (FIG. 58, SEQ ID NO:100) is 401 amino acids long. Other features of the PRO1326 protein include: a signal sequence at about amino acids 1–29; a ribosomal protein S3Ae homologous region at about amino acids 129–166; and potential N-glycosylation sites at about amino acids 109–112, 144–147 and 398401. PRO1326 has a calculated molecular weight of approximately 45,333 daltons and an estimated pI of approximately 4.95. Clone DNA62808-1582 was deposited with the ATCC on Oct. 20, 1998 and is assigned ATCC deposit no. 203358.

An analysis of the Dayhoff database (version 35.45 SwissProt 35), using a WU-BLAST2 sequence alignment analysis of the full-length sequence shown in FIG. 58 (SEQ ID NO:100), revealed some homology between the PRO1326 amino acid sequence and the following Dayhoff sequences: AC004013_1, HROMHCEMB_1, CEF47A4_2, A45592, MYSP_HUMAN, NFU43192_1, ONGMBWMZ_1, CELC25A11_2, CELC25A11_1, and A42184.

Example 33

Isolation of cDNA clones Encoding Human PRO1249

Use of the signal sequence algorithm described in Example 3 above allowed identification of an EST cluster sequence from the Incyte database, designated Incyte EST cluster no. 122605. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56060.

In light of the sequence homology between the DNA56060 sequence and an EST sequence contained within the Incyte EST clone no. 2630770, the Incyte EST clone no. 2630770 was purchased and the cDNA insert was obtained and sequenced. The sequence of this cDNA insert is shown in FIG. 59 and is herein designated as DNA62809-1531.

Clone DNA62809-1531 contains a single open reading frame with an apparent translational initiation site at nucleotide positions 3–5 and ending at the stop codon at nucleotide positions 3270–3272 (FIG. 59). The predicted polypeptide precursor is 1089 amino acids long (FIG. 60). The full-length PRO1249 protein shown in FIG. 60 has an estimated molecular weight of about 118,699 daltons and a pI of about 8.49. Analysis of the full-length PRO1249 sequence shown in FIG. 60 (SEQ ID NO:102) evidences the presence of the following: a signal peptide from about amino acid 1 to about amino acid 16, transmembrane domains from about amino acid position 317 to about amino acid position 341, from about amino acid position 451 to about amino acid position 470, from about amino acid position 481 to about amino acid position 500, from about amino acid position 510 to about amino acid position 527, from about amino acid position 538 to about amino acid position 555, from about amino acid position 831 to about amino acid position 850, from about amino acid position 1016 to about amino acid position 1034 and from about amino acid position 1052 to about amino acid position 1070, a leucine zipper pattern sequence from about amino acid 843 to about amino acid 864 and potential N-glycosylations sites from about amino acid 37 to about amino acid 40 and from about amino acid 268 to about amino acid 271. Clone DNA62809-1531 has been deposited with ATCC on Sep. 9, 1998 and is assigned ATCC deposit no. 203237.

An analysis of the Dayhoff database (version 35.45 SwissProt 35), using a WU-BLAST2 sequence alignment analysis of the full-length sequence shown in FIG. 60 (SEQ ID NO:102), evidenced significant homology between the PRO1249 amino acid sequence and the following Dayhoff sequences: AC004472_3, AB004539_7, S64782, S62432, YJG2_YEAST, CELC27A12_8, YKQ5_YEAST, AB009505_3, SPBC24E9_8 and AF060218_4.

Example 34

Isolation of cDNA Clones Encoding Human PRO1315

A consensus DNA sequence was assembled relative to other EST sequences using phrap as described in Example 1 above. This consensus sequence is herein designated DNA35925. Based on the DNA35925 consensus sequence, oligonucleotides were synthesized: 1) to identify by PCR a cDNA library that contained the sequence of interest, and 2) for use as probes to isolate a clone of the full-length coding sequence for PRO1315.

PCR primers (forward and reverse) were synthesized:
forward PCR primer (35925.f1)
5'-CGCTGCTGCTGTTGCTCCTGG-3' (SEQ ID NO:105)
forward PCR primer (35925.f2)
5'-CAGTGTGCCAGGACTTTG-3' (SEQ ID NO:106)
forward PCR primer (35925.f3)
5'-AGTCGCAGGCAGCGTTGG-3' (SEQ ID NO:107)
reverse PCR primer (35925.r1)
5'-CTCCTCCGAGTCTGTGTGCTCCTGC-3' (SEQ ID NO:108)

Additionally, a synthetic oligonucleotide hybridization probe was constructed from the consensus DNA35925 sequence which had the following nucleotide sequence hybridization probe (35925.p1)
5'-GGACGGGCAGTTCCCTGTGTCTCTGGTGGTTTG CCTAAACCTGCAAACATC-3' (SEQ ID NO:109)

In order to screen several libraries for a source of a full-length clone, DNA from the libraries was screened by PCR amplification with the PCR primer pair identified above. A positive library was then used to isolate clones encoding the PRO1315 gene using the probe oligonucleotide and one of the PCR primers. RNA for construction of the cDNA libraries was isolated from human retina tissue.

DNA sequencing of the clones isolated as described above gave the full-length DNA sequence for PRO1315 (designated herein as DNA62815-1576 [FIG. 61, SEQ ID NO:103]; and the derived protein sequence for PRO1315.

The entire nucleotide sequence of DNA62815-1576 is shown in FIG. 61 (SEQ ID NO:103). Clone DNA62815-1576 contains a single open reading frame with an apparent translational initiation site at nucleotide positions 121–123 and ending at the stop codon at nucleotide positions 1447–1449 (FIG. 61). The predicted polypeptide precursor is 442 amino acids long (FIG. 62). The full-length PRO1315 protein shown in FIG. 62 has an estimated molecular weight of about 49,932 daltons and a pI of about 4.55. Analysis of the full-length PRO1315 sequence shown in FIG. 62 (SEQ ID NO:104) evidences the presence of the following: a signal peptide from about amino acid 1 to about amino acid 28, a transmembrane domain from about amino acid 140 to about amino acid 163 and potential N-glycosylation sites from about amino acid 71 to about amino acid 74, from about amino acid 80 to about amino acid 83, from about amino acid 89 to about amino acid 92, from about amino acid 204 to about amino acid 207 and from about amino acid 423 to about amino acid 426. Clone DNA62815-1576 has been deposited with ATCC on Sep. 9, 1998 and is assigned ATCC deposit no. 203247.

An analysis of the Dayhoff database (version 35.45 SwissProt 35), using a WU-BLAST2 sequence alignment analysis of the full-length sequence shown in FIG. 62 (SEQ ID NO:104), evidenced significant homology between the PRO1315 amino acid sequence and the following Dayhoff sequences: MMU53696_1, NVY08571_2, B64560, STMSLPE_1, P_R80508, P_W19258, A55817, GEN14043, AE000768_7 and RNMUCASGP5_1pSMC.

Example 35

Isolation of cDNA Clones Encoding Human PRO1599

Incyte EST no. 1491360 was identified as a sequence of interest using the techniques described in Example 1 above having a BLAST score of 70 or greater that does not encode a known protein. The nucleotide sequence of EST no. 1491360 and its complementary sequence is designated herein "DNA37192". Based on the DNA37192 sequence, oligonucleotides were synthesized: 1) to identify by PCR a cDNA library that contained the sequence of interest, and 2) for use as probes to isolate a clone of the full-length coding sequence for PRO1599.

PCR primers (forward and reverse) were synthesized:
forward PCR primer: GACGTCTGCAACAGCTCCTG-GAAG (37192.f1; SEQ ID NO:112)
reverse PCR primer: CGAGAAGGAAACGAGGCCGT-GAG (37192.r1; SEQ ID NO:113)

Additionally, a synthetic oligonucleotide hybridization probe was constructed from the consensus DNA37192 sequence which had the following nucleotide sequence: hybridization probe: TGACACTTACCATGCTCTGCAC-CCGCAGTGGGGACAGCCACAGA (SEQ ID NO:114).

In order to screen several libraries for a source of a full-length clone, DNA from the libraries was screened by PCR amplification with the PCR primer pair identified above. A positive library was then used to isolate clones encoding the PRO1599 gene using the probe oligonucleotide and one of the PCR primers. RNA for construction of the cDNA libraries was isolated from human fetal liver tissue.

DNA sequencing of the clones isolated as described above gave the full-length DNA sequence for PRO1599 (designated herein as DNA62845-1684 [FIG. 63, SEQ ID NO:110]; and the derived protein sequence for PRO1599.

The entire coding sequence of PRO1599 is shown in FIG. 63 (SEQ ID NO:110). Clone DNA62845-1684 contains a single open reading frame with an apparent translational initiation site at nucleotide positions 69–71 and an apparent stop codon at nucleotide positions 918–920. The predicted polypeptide precursor is 283 amino acids long. The full-length PRO1599 protein shown in FIG. 64 has an estimated molecular weight of about 30,350 daltons and a pI of about 9.66. Additional features of PRO1599 include: a signal peptide at about amino acids 1–30; potential N-glycosylation sites at about amino acids 129–132 and 189–192; a potential cAMP and cGMP-dependent protein kinase phosphorylation site at about amino acids 263–266; potential N-myristoylation sites at about amino acids 28–33, 55–60, 174–179, and 236–241; a potential amidation site at about amino acids 144–147; and a serine protease, trypsin family, histidine active site at about amino acids 70–75.

An analysis of the Dayhoff database (version 35.45 SwissProt 35), using a WU-BLAST2 sequence alignment analysis of the full-length sequence shown in FIG. 64 (SEQ ID NO:111), revealed significant homology between the PRO1599 amino acid sequence and the following Dayhoff sequence: CFAD_PIG. Homology was also found between the PRO1599 amino acids sequence and the following additional Dayhoff sequences. CFAD_HUMAN; P_R05421; P_R55757; P_R05772; GRAM_HUMAN; MUSLMET_1; P_P80335; P_R55758; A42048_1; and P_W05383.

Clone DNA62845-1684 was deposited with the ATCC on Oct. 20, 1998 and is assigned ATCC deposit no. 203361.

Example 36

Isolation of cDNA Clones Encoding Human PRO1430

A DNA sequence designated herein as DNA49433 was obtained as described in Example 1 above. Merck EST no. T49469, which was identified as being an EST of interest from the assembly, was purchased and the cDNA insert was obtained and sequenced in entirety.

DNA sequencing of the clone as described above gave the full-length DNA sequence for PRO1430, which is designated herein as "DNA64842-1632" (SEQ ID NO:115), and the derived protein sequence for PRO1430 (SEQ ID NO:116). Clone DNA64842-1632 contains a single open reading frame with an apparent translational initiation site at nucleotide positions 82–84, and an apparent stop codon at nucleotide positions 1075–1077. The full-length PRO1430 protein shown in FIG. 66 has an estimated molecular weight of about 35,932 daltons and a pI of about 8.45. The predicted polypeptide precursor is 331 amino acids long. Additional features include a signal peptide at about amino acids 1–17; a potential N-glycosylation site at about amino acids 171–174, and regions of homology with short chain alcohol dehydrogenase family proteins at about amino acids 29–51, 116–126, 180–217, and 222–230.

An analysis of the Dayhoff database (version 35.45 SwissProt 35), using a WU-BLAST2 sequence alignment analysis of the full-length sequence shown in FIG. 66 (SEQ ID NO:116), revealed significant homology between the PRO1430 amino acid sequence and Dayhoff sequence no. P_W03198. Homology was also found between the PRO1430 amino acid sequence and the following Dayhoff sequences: MTV030_10, MTV037_2, A40116_1, S42651, CEC15H11_6, SPCC736_13, SCU43704_1, S19842, OXIR_STRAT, and OXIR_STRLI.

Clone DNA64842-1632 has been deposited with ATCC and is assigned ATCC deposit no. 203278.

Example 37

Isolation of cDNA Clones Encoding Human PRO1374

A consensus DNA sequence encoding PRO1374 was assembled relative to other EST sequences using phrap as described in Example 1 above. This consensus sequence is designated herein "DNA47357". Based on the DNA47357 consensus sequence, oligonucleotides were synthesized: 1) to identify by PCR a cDNA library that contained the sequence of interest, and 2) for use as probes to isolate a clone of the full-length coding sequence for PRO1374.

PCR primers (forward and reverse) were synthesized:
forward PCR primer 5' CGGGACAGGAGACCCA-GAAAGGG3' (SEQ ID NO:119) and;
reverse PCR primer 5'GGCCAAGTGATCCAAG-GCATCTTC3' (SEQ ID NO:120).

Additionally, a synthetic oligonucleotide hybridization probe was constructed from the consensus DNA47357 sequence which had the following nucleotide sequence: hybridization probe 5'CTGCGGGACCTGACTAGATTC-TACGACAAGGTACTTTCTTTGCATGGGG 3' (SEQ ID NO:121).

In order to screen several libraries for a source of a full-length clone, DNA from the libraries was screened by PCR amplification with the PCR primer pair identified above. A positive library was then used to isolate clones encoding the PRO1374 gene using the probe oligonucleotide and one of the PCR primers. RNA for construction of the cDNA libraries was isolated from a human adenocarcinoma cell line.

DNA sequencing of the clones isolated as described above gave the full-length DNA sequence for PRO1374 and the derived protein sequence for PRO1374.

The entire coding sequence of PRO1374 is shown in FIG. 67 (SEQ ID NO:117). Clone DNA64849-1604 contains a single open reading frame with an apparent translational initiation site at nucleotide positions 20–22 and an apparent stop codon at nucleotide positions 1653–1655 of SEQ ID NO:117. The predicted polypeptide precursor is 544 amino acids long. The approximate locations of the signal peptide, N-glycosylation sites, leucine zipper patterns, and ribonucleotide reductase small subunit signature are indicated in FIG. 68. Clone DNA64849-1604 has been deposited with the ATCC and is assigned ATCC deposit no. 203468. The full-length PRO1374 protein shown in FIG. 68 has an estimated molecular weight of about 61,126 daltons and a pI of about 6.4.

An analysis of the Dayhoff database (version 35.45 SwissProt 35), using a WU-BLAST2 sequence alignment analysis of the full-length sequence shown in FIG. 68 (SEQ ID NO:118), revealed sequence identity between the PRO1374 amino acid sequence and the following Dayhoff sequences: CEF35G2_4, P_W37046, S44204, CET28D6_1, CET20B3_6, CELC14E2_3, CUAL_CHICK, ATM7J2_3, S74997 and HIVH5994R8_1.

Example 38

Isolation of cDNA Clones Encoding Human PRO1311

A cDNA sequence isolated in the amylase screen described in Example 2 above is herein designated DNA37721. The DNA37721 sequence was then compared to a variety of expressed sequence tag (EST) databases which included public EST databases (e.g., GenBank) and proprietary EST DNA databases (LIFESEQ™, Incyte Pharmaceuticals, Palo Alto, Calif.; Genentech, South San Francisco, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is herein designated "DNA48616". Based on the DNA48616 sequence, oligonucleotide probes were generated and used to screen a human aortic endothelial cell library prepared as described in paragraph 1 of Example 2 above. The cloning vector was pRK5B (pRK5B is a precursor of pRK5D that does not contain the SfiI site; see, Holmes et al., *Science* 253:1278–1280 (1991)), and the cDNA size cut was less than 2800 bp.

PCR primers (forward and reverse) were synthesized:
forward PCR primer (48616.f1)
5'-ATCATCTATTCCACCGTGTTCTGGC-3' (SEQ ID NO:124)
reverse PCR primer (48616.r1)
5'-GACAGAGTGCTCCATGATGATGTCC-3' (SEQ ID NO:125)
Additionally, a synthetic oligonucleotide hybridization probe was constructed from the DNA48616 sequence which had the following nucleotide sequence:
hybridization probe (48616.p1)
5'-CCTGTCTGTGGGCATCTATGCAGAGGTTGAGCG GCAGAAATATAAAACCC-3' (SEQ ID NO:126)

In order to screen several libraries for a source of a full-length clone, DNA from the libraries was screened by PCR amplification with the PCR primer pair identified above. A positive library was then used to isolate clones encoding the PRO1311 gene using the probe oligonucleotide and one of the PCR primers.

A full length clone was identified that contained a single open reading frame with an apparent translational initiation site at nucleotide positions 195–197, and a stop signal at nucleotide positions 1077–1079 (FIG. 69; SEQ ID NO:122). The predicted polypeptide precursor is 294 amino acids long has a calculated molecular weight of approximately 33,211 daltons and an estimated pI of approximately 5.35 Additional features include: a signal sequence at about amino acids 1–44; possible transmembrane domains at about amino acids 22–42, 57–85, 94–116, and 230–257; potential N-glycosylation sites at about amino acids 118–121, 1899–192, and 230–233; potential tyrosine kinase phosphorylation sites at about amino acids 3–11 and 129–136; potential N-myristoylation sites at about amino acids 80–85, 109–114, 180–185, 218–223, 248–253, 276–281, 285–290, and 287–292; and a cell attachment sequence at about amino acids 3–5.

An analysis of the Dayhoff database (version 35.45 SwissProt 35), using a WU-BLAST2 sequence alignment analysis of the full-length sequence shown in FIG. 70 (SEQ ID NO:123), evidenced some homology between the PRO1311 amino acid sequence and the following Dayhoff sequences: AF065389_1, AF053455_1, CD63_HUMAN, A15_HUMAN, AF043906_1, C151_HUMAN, AF053453_1, AF054838_1, P_R91446, and CD82_HUMAN.

Clone DNA64863-1573 was deposited with the ATCC on Sep. 9, 1998, and is assigned ATCC deposit no. 203251.

Example 39

Isolation of cDNA Clones Encoding Human PRO1357

Use of the signal sequence algorithm described in Example 3 above allowed identification of an EST cluster sequence from the Incyte database, designated Incyte EST cluster sequence no. 69537. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56034.

In light of the sequence homology between the DNA56034 sequence and an EST sequence contained within the Incyte EST clone no. 936239, the Incyte EST clone no. 936239 was purchased and the cDNA insert was obtained and sequenced. The sequence of this cDNA insert is shown in FIG. 71 and is herein designated as DNA64881-1602.

Clone DNA64881-1602 contains a single open reading frame with an apparent translational initiation site at nucleotide positions 74–76 and ending at the stop codon at nucleotide positions 1526–1528 (FIG. 71). The predicted polypeptide precursor is 484 amino acids long (FIG. 72). The full-length PRO1357 protein shown in FIG. 72 has an estimated molecular weight of about 52,468 daltons and a pI of about 7.14. Analysis of the full-length PRO1357 sequence shown in FIG. 72 (SEQ ID NO:128) evidences the presence of the following: a signal peptide from about amino acid 1 to about amino acid 21, potential N-glycosylation sites from about amino acid 48 to about amino acid 51, from about amino acid 264 to about amino acid 267 and from about amino acid 401 to about amino acid 404, a glycosaminoglycan attachment site from about amino acid 412 to about amino acid 415 and an amino acid sequence block having homology to the LBP/BPI/CETP family of proteins from about amino acid 407 to about amino acid 457. Clone DNA64881-1602 has been deposited with ATCC on Sep. 9, 1998 and is assigned ATCC deposit no. 203240.

An analysis of the Dayhoff database (version 35.45 SwissProt 35), using a WU-BLAST2 sequence alignment analysis of the full-length sequence shown in FIG. 72 (SEQ ID NO:128), evidenced significant homology between the PRO1357 amino acid sequence and the following Dayhoff sequences: MMU46068_1, S17447, MMU1_1, BPI_ RABIT, P_W16808, P_R21844, PSP_MOUSE, HSLBPEX1_1 and BTU79413_1.

EXAMPLE 40

Isolation of cDNA clones Encoding Human PRO1244

Use of the signal sequence algorithm described in Example 3 above allowed identification of an EST cluster sequence from the LIFESEQ® database, designated cluster no. 7874. This EST cluster sequence was then compared to a variety of expressed sequence tag (EST) databases which included public EST databases (e.g., GenBank) and a proprietary EST DNA databases (LIFESEQ®, Incyte Pharmaceuticals, Palo Alto, Calif.; Genentech, South San Francisco, Calif.) to identify existing homologies. One or more of the ESTs was derived from a library constructed from tissue of the corpus cavemosum. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated "DNA56011".

In light of the sequence homology between the DNA56011 sequence and an EST sequence contained within Incyte EST No. 3202349, the EST clone no. 3202349 was purchased and the cDNA insert was obtained and sequenced. The sequence of this cDNA insert is shown in FIG. 73 (SEQ ID NO:129) and is herein designated "DNA64883-1526".

The full length clone shown in FIG. 73 contained a single open reading frame with an apparent translational initiation site at nucleotide positions 9–11 and ending at the stop codon found at nucleotide positions 1014–1016 (FIG. 73; SEQ ID NO:129). The predicted polypeptide precursor (FIG. 74, SEQ ID NO:130) is 335 amino acids long. PRO1244 has a calculated molecular weight of approximately 38,037 daltons and an estimated pI of approximately 9.87. Other features include a signal peptide at about amino acids 1–29; transmembrane domains at about amino acids 183–205, 217–237, 271–287, and 301–321; potential N-glycosylation sites at about amino acids 71–74, and 215–218; and a cell attachment sequence at about amino acids 150–152.

An analysis of the Dayhoff database (version 35.45 SwissProt 35), using a WU-BLAST2 sequence alignment analysis of the full-length sequence shown in FIG. 74 (SEQ ID NO:130), revealed homology between the PRO1244 amino acid sequence and the following Dayhoff sequences: AF008554_1, P_485334, G02297, HUMN33S11_1, HUMN33S10_1, YO13_CAEEL, GEN13255, S49758, E70107, and ERP5_MEDSA.

Clone DNA64883-1526 was deposited with the ATCC on Sep. 9, 1998, and is assigned ATCC deposit no. 203253.

Example 41

Isolation of cDNA Clones Encoding Human PRO1246

Use of the signal sequence algorithm described in Example 3 above allowed identification of an EST cluster sequence from the Incyte database, designated Incyte EST cluster sequence no. 56853. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56021.

In light of the sequence homology between the DNA56021 sequence and an EST sequence contained within the Incyte EST clone no. 2481345, the Incyte EST clone no. 2481345 was purchased and the cDNA insert was obtained and sequenced. The sequence of this cDNA insert is shown in FIG. 75 and is herein designated as DNA64885-1529.

Clone DNA64885-1529 contains a single open reading frame with an apparent translational initiation site at nucleotide positions 119–121 and ending at the stop codon at nucleotide positions 1727–1729 (FIG. 75). The predicted polypeptide precursor is 536 amino acids long (FIG. 76). The full-length PRO1246 protein shown in FIG. 76 has an estimated molecular weight of about 61,450 daltons and a pI of about 9.17. Analysis of the full-length PRO1246 sequence shown in FIG. 76 (SEQ ID NO:132) evidences the presence of the following: a signal peptide from about amino acid 1 to about amino acid 15, potential N-glycosylation sites from about amino acid 108 to about amino acid 111, from about amino acid 166 to about amino acid 169, from about amino acid 193 to about amino acid 196, from about amino acid 262 to about amino acid 265, from about amino acid 375 to about amino acid 378, from about amino acid 413 to about amino acid 416 and from about amino acid 498 to about amino acid 501 and amino acid sequence blocks having homology to sulfatase proteins from about amino acid 286 to about amino acid 315, from about amino acid 359 to about amino acid 369 and from about amino acid 78 to about amino acid 97. Clone DNA64885-1529 has been deposited with ATCC on Nov. 3, 1998 and is assigned ATCC deposit no. 203457.

An analysis of the Dayhoff database (version 35.45 SwissProt 35), using a WU-BLAST2 sequence alignment analysis of the full-length sequence shown in FIG. 76 (SEQ ID NO:132), evidenced significant homology between the PRO1246 amino acid sequence and the following Dayhoff sequences: P_R51355, CELK09C4_1, BCU44852_1, IDS_HUMAN, G65169, E64903, ARSA_HUMAN, GL6S_HUMAN, HSARSF_1 and GEN12648.

Example 42

Isolation of cDNA Clones Encoding Human PRO1356

Use of the signal sequence algorithm described in Example 3 above allowed identification of an EST cluster sequence from the Incyte database, designated Incyte EST cluster sequence no. 44725. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56023.

In light of the sequence homology between the DNA56023 sequence and an EST sequence contained within the Incyte EST clone no. 4071746, the Incyte EST clone no. 4071746 was purchased and the cDNA insert was obtained and sequenced. The sequence of this cDNA insert is shown in FIG. 77 and is herein designated as DNA64886-1601.

Clone DNA64886-1601 contains a single open reading frame with an apparent translational initiation site at nucleotide positions 122–124 and ending at the stop codon at nucleotide positions 812–814 (FIG. 77). The predicted polypeptide precursor is 230 amino acids long (FIG. 78). The full-length PRO1356 protein shown in FIG. 78 has an estimated molecular weight of about 24,549 daltons and a pI of about 8.56. Analysis of the full-length PRO1356 sequence shown in FIG. 78 (SEQ ID NO:134) evidences the presence of the following: a signal peptide from about amino acid 1 to about amino acid 24, transmembrane domains from about amino acid 82 to about amino acid 102, from about amino acid 117 to about amino acid 140 and from about amino acid 163 to about amino acid 182, a potential N-glycosylation site from about amino acid 190 to about amino acid 193 and an amino acid sequence block having homology to the PMP-22/EMP/MP20 family of proteins from about amino acid 46 to about amino acid 59. Clone DNA64886-1601 has been deposited with ATCC on Sep. 9, 1998 and is assigned ATCC deposit no. 203241.

An analysis of the Dayhoff database (version 35.45 SwissProt 35), using a WU-BLAST2 sequence alignment analysis of the full-length sequence shown in FIG. 78 (SEQ ID NO:134), evidenced significant homology between the PRO1356 amino acid sequence and the following Dayhoff sequences: AB00014_1, AB000712_1, A39484, AF000959_1, AF035814_1, HSU89916_1, MMU19582_1, P_R30059, HUAC004125_1 and PM22 RAT.

Example 43

Isolation of cDNA Clones Encoding Human PRO1275

A novel secreted molecule, designated herein as DNA57700, was used to BLAST against Incyte's (LIFESEQ®, Incyte Pharmaceuticals, Palo Alto, Calif.) proprietary database and Genbank's public database. Positive clones were identified and used to generate assembly files by seqext program. The search was performed using the computer program BLAST or BLAST2 [Altschul et al., *Methods in Enzymology*, 266:460–480 (1996)] as a comparison of the ECD protein sequences to a 6 frame translation of the EST sequences. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.).

A consensus DNA sequence was assembled relative to other EST sequences using repeated cycles of BLAST and phrap. This consensus sequence is designated herein "DNA59572".

Based on the DNA59572 consensus sequence and its relation to sequences identified in the assembly, one of the clones (Incyte clone 2026581) including one of the sequences in the assembly was purchased and sequenced. Incyte clone 2026581 came from a library constructed of RNA from epidermal breast keratinocytes.

The entire coding sequence of PRO1275 is shown in FIG. 79 (SEQ ID NO:135). Clone DNA64888-1542 contains a single open reading frame with an apparent translational initiation site at nucleotide positions 37–39 and an apparent stop codon at nucleotide positions 394–396 of SEQ ID NO:135. The predicted polypeptide precursor is 119 amino acids long. The signal peptide is at about amino acids 1–25 of SEQ ID NO:136. Clone DNA64888-1542 has been deposited with ATCC and is assigned ATCC deposit no. 203249. The full-length PRO1275 protein shown in FIG. 79 has an estimated molecular weight of about 13,248 daltons and a pI of about 7.78.

An analysis of the Dayhoff database (version 35.45 SwissProt 35), using a WU-BLAST2 sequence alignment analysis of the full-length sequence shown in FIG. 80 (SEQ ID NO:136), revealed sequence identity between the PRO1275 amino acid sequence and the following Dayhoff sequences (information from database incorporated herein): B48151 (Mst98Cb), D86424_1 (high-sulfur keratin protein), P_R79964 (connective tissue growth factor), CHRD_RAT (chordin), MT_DREPO (metallothionein), PL05_PLETR (plectoxins), P_R25156 (Ig antigen), S73732_1 (VLDP), AF025440_1 (OIP4) and P_R32757 (IGF-II).

Example 44

Isolation of cDNA Clones Encoding Human PRO1274

A novel secreted molecule, designated herein as DNA57700, was used to blast against Incyte's (LIFESEQ®, Incyte Pharmaceuticals, Palo Alto, Calif.) proprietary database and Genbank's public database. Positive clones were identified and used to generate assembly files by seqext program. The search was performed using the computer program BLAST or BLAST2 [Altschul et al., *Methods in Enzymology*, 266:460–480 (1996)] as a comparison of the ECD protein sequences to a 6 frame translation of the EST sequences. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.).

A consensus DNA sequence was assembled relative to other EST sequences using repeated cycles of BLAST and phrap. This consensus sequence is designated herein "DNA59573".

Based on the DNA59573 consensus sequence and its relation to sequences identified in the assembly, one of the clones (Incyte clone 2623992) including one of the sequences in the assembly was purchased and sequenced. Incyte clone 2623992 came from a library constructed of RNA from epidermal breast keratinocytes.

The entire coding sequence of PRO1274 is shown in FIG. 81 (SEQ ID NO:137). Clone DNA64889-1541 contains a single open reading frame with an apparent translational initiation site at nucleotide positions 24–26, and an apparent stop codon at nucleotide positions 354–356 of SEQ ID NO:137. The predicted polypeptide precursor is 110 amino acids long. The signal peptide is at about 1–24 of SEQ ID NO:138. Conserved regions in the insulin family of proteins and an N-glycosylation site are indicated in FIG. 82. Clone DNA64889-1541 has been deposited with ATCC and is assigned ATCC deposit no. 203250. The full-length PRO1274 protein shown in FIG. 82 has an estimated molecular weight of about 12,363 daltons and a pI of about 8.31.

An analysis of the Dayhoff database (version 35.45 SwissProt 35), using a WU-BLAST2 sequence alignment analysis of the full-length sequence shown in FIG. 82 (SEQ ID NO:138), revealed sequence identity between the PRO1274 amino acid sequence and the following Dayhoff sequences (information from database incorporated herein): CEW05B2_9, AF016922_1 (insulin-like growth factor 1), B48151, A53640, BTIGF2REC_1 (insulin-like growth factor 2), HSNF1GEN12_1, TXA3_RADMA (neurotoxin 3), CXM1_CONGE, P_P61301, TXA4_RADMA (neurotoxin 4).

Example 45

Isolation of cDNA Clones Encoding Human PRO1412

Use of the signal sequence algorithm described in Example 3 above allowed identification of an EST cluster sequence from the LIFESEQ® database, designated Incyte Cluster No. 101368, also referred herein as "DNA10643". This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). One or more of the ESTs was derived from RNA isolated from fibroblasts of the prostate stroma removed from a male fetus. The consensus sequence obtained therefrom is herein designated "DNA58754".

In light of the sequence homology between the DNA58754 sequence and an EST sequence contained within EST no. 3597385, the EST clone 3597385 was purchased and the cDNA insert was obtained and sequenced in its entirety. The sequence of this cDNA insert is shown in FIG. 83 and is herein designated as "DNA64897-1628".

The full length clone shown in FIG. 83 contained a single open reading frame with an apparent translational initiation site at nucleotide positions 142 to 144 and ending at the stop codon found at nucleotide positions 1075 to 1077 (FIG. 83; SEQ ID NO:139). The predicted polypeptide precursor (FIG. 84, SEQ ID NO:140) is 311 amino acids long. Other features of the PRO1412 protein include: a signal sequence at about amino acids 1–28; a transmembrane domain at about amino acids 190–216; potential N-glycosylation sites at about amino acids 49–52, 91–94, 108–111, 128–131, 135–138 and 190–193; a tyrosine kinase phosphorylation site at about amino acids 62–69; and a lysosome-associated membrane glycoprotein duplicated domain at about amino acids 183–224. PRO1412 has a calculated molecular weight of approximately 33,908 daltons and an estimated pI of approximately 6.87. Clone DNA64897-1628 was deposited with the ATCC on Sep. 15, 1998, and is assigned ATCC deposit no. 203216.

An analysis of the Dayhoff database (version 35.45 SwissProt 35), using a WU-BLAST2 sequence alignment analysis of the full-length sequence shown in FIG. 84 (SEQ ID NO:140), revealed some homology between the PRO1412 amino acid sequence and the following Dayhoff sequences: 150116, AF035963_1, NCA2_RAT, I61783, P_W07682, MMHC135G15_3, S21461, MMIGL2_1, ONHIGMV9A_1 and MMU70448_1.

Example 46

Isolation of cDNA Clones Encoding Human PRO1557

Use of the signal sequence algorithm described in Example 3 above allowed identification of an EST sequence from the Genentech database, designated "DNA58763." This EST sequence was then compared to a variety of expressed sequence tag (EST) databases, which included the EST databases listed above, to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained from the assembly is herein designated "DNA58763".

In light of the sequence homology between the DNA58763 sequence and an EST sequence contained within the EST no.2267403, EST no. 2267403 was purchased and the cDNA insert was obtained and sequenced. The sequence of this cDNA insert is shown in FIG. 85 and is herein designated as DNA64902-1667.

The full length clone shown in FIG. 85 contained a single open reading frame with an apparent translational initiation site at nucleotide positions 287 to 289 and ending at the stop codon found at nucleotide positions 1640 to 1642 (FIG. 85; SEQ ID NO:141). The predicted polypeptide precursor (FIG. 86, SEQ ID NO:142) is 451 amino acids long. PRO1557 has a calculated molecular weight of approximately 49,675 daltons and an estimated pI of approximately 7.15. Additional features include: a signal sequence at about amino acids 1–25; a potential N-glycosylation site at about amino acids 114–117; a potential cAMP and cGMP-dependent protein kinase phosphorylation site at about amino acids 38841; potential N-myristoylation sites at about amino acids 54–49, 66–71, 146–151, and 367–372; potential amidation sites at about amino acids 36–39 and 205–208; and an ATP/GTP-binding site motif A (P-loop) at about amino acids 151–258.

An analysis of the Dayhoff database (version 35.45 SwissProt 35), using a WU-BLAST2 sequence alignment analysis of the full-length sequence shown in FIG. 86 (SEQ ID NO:142), revealed significant homology between the PRO1557 amino acid sequence and Dayhoff sequence AF034606_1. Homology was also found between the PRO1557 amino acid sequence and the following Dayhoff sequences: P_W31559, AF031230_1, SOG_DROME, CA11_MOUSE, P_R41320, CHRD_RAT, P_W40288, NEL_CHICK, and HSMUC5B_1.

Clone DNA64902-1667 was deposited with the ATCC on Oct. 6, 1998, and is assigned ATCC deposit no. 203317.

Example 47

Isolation of cDNA Clones Encoding Human PRO1286

Use of the signal sequence algorithm described in Example 3 above allowed identification of an EST cluster sequence from the LIFESEQ® database, designated EST Cluster No. 86809. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). ESTs in the assembly included those identified from tumors, cell lines, or diseased tissue. One or more of the ESTs was obtained from a cDNA library constructed from RNA isolated from diseased colon tissue. The consensus sequence obtained therefrom is herein designated DNA58822.

In light of the sequence homology between the DNA58822 sequence and an EST sequence contained within EST no. 1695434, EST clone no. 1695434 was purchased and the cDNA insert was obtained and sequenced. The sequence of this cDNA insert is shown in FIG. 87 and is herein designated DNA64903-1553 (SEQ ID NO:143).

The full length clone shown in FIG. 87 contained a single open reading frame with an apparent translational initiation site at nucleotide positions 93–95 and ending at the stop codon found at nucleotide positions 372–374 (FIG. 87; SEQ ID NO:143). The predicted polypeptide precursor (FIG. 88, SEQ ID NO:144) is 93 amino acids long, with a signal sequence at about amino acids 1–18. PRO1286 has a calculated molecular weight of approximately 10,111 daltons and an estimated pI of approximately 9.70.

An analysis of the Dayhoff database (version 35.45 SwissProt 35), using a WU-BLAST2 sequence alignment analysis of the full-length sequence shown in FIG. 88 (SEQ ID NO:144), revealed some homology between the PRO1286 amino acid sequence and the following Dayhoff sequences: SR5C_ARATH, CELC17H12_11, MCPD_ENTAE, JQ2283, INVO_LEMCA, P_R07309, ADEVBCAGN_4, AF020947_1, CELT23H2_1, and MDH_STRAR.

Clone DNA64903-1553 was deposited with the ATCC on Sep. 15, 1998 and is assigned ATCC deposit no. 203223.

Example 48

Isolation of cDNA Clones Encoding Human PRO1294

Use of the signal sequence algorithm described in Example 3 above allowed identification of an EST cluster sequence from the Incyte database, designated Incyte EST cluster sequence no. 10559. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57203.

In light of the sequence homology between the DNA57203 sequence and an EST sequence contained within the Incyte EST clone no. 3037763, the Incyte EST clone no. 3037763 was purchased and the cDNA insert was obtained and sequenced. The sequence of this cDNA insert is shown in FIG. 89 and is herein designated as DNA64905-1558.

Clone DNA64905-1558 contains a single open reading frame with an apparent translational initiation site at nucleotide positions 110–112 and ending at the stop codon at nucleotide positions 1328–1330 (FIG. 89). The predicted polypeptide precursor is 406 amino acids long (FIG. 90). The full-length PRO1294 protein shown in FIG. 90 has an estimated molecular weight of about 46,038 daltons and a pI of about 6.50. Analysis of the full-length PRO1294 sequence shown in FIG. 90 (SEQ ID NO:146) evidences the presence of the following: a signal peptide from about amino acid 1 to about amino acid 21 and potential N-glycosylation sites from about amino acid 177 to about amino acid 180 and from about amino acid 248 to about amino acid 251. Clone DNA64905-1558 has been deposited with ATCC on Sep. 15, 1998 and is assigned ATCC deposit no.203233.

An analysis of the Dayhoff database (version 35.45 SwissProt 35), using a WU-BLAST2 sequence alignment analysis of the full-length sequence shown in FIG. 90 (SEQ ID NO:146), evidenced significant homology between the PRO1294 amino acid sequence and the following Dayhoff sequences: 173636, AF028740_1, AB006686S3_1, P_R98225, RNU78105_1, CELC48E7_4, CEF11C3_3, SCP1_MESAU, TPM3_HUMAN and CELKO5B2_3.

Example 49

Isolation of cDNA Clones Encoding Human PRO1347

A consensus DNA sequence was assembled relative to other EST sequences using phrap as described in Example 1 above. This consensus sequence is designated herein "DNA47373". Based on the DNA47373 consensus sequence, oligonucleotides were synthesized: 1) to identify by PCR a cDNA library that contained the sequence of interest, and 2) for use as probes to isolate a clone of the full-length coding sequence for PRO1347.

PCR primers (forward and reverse) were synthesized:
forward PCR primer 5'GCGTGGTCCACCTCTACAGG-GACG3' (SEQ ID NO:149); and
reverse PCR primer 5'GGAACTGACCCAGTGCTGA-CACC3' (SEQ ID NO:150).

Additionally, a synthetic oligonucleotide hybridization probe was constructed from the consensus DNA47373 sequence which had the following nucleotide sequence:
hybridization probe 5'GCAGATGCCACAGTATCAAG-GCAGGACAAAACTGGTGAAGGATTC3' (SEQ ID NO:151).

In order to screen several libraries for a source of a full-length clone, DNA from the libraries was screened by PCR amplification with the PCR primer pair identified above. A positive library was then used to isolate clones encoding the PRO1347 gene using the probe oligonucleotide and one of the PCR primers. RNA for construction of the cDNA libraries was isolated from human small intestine.

DNA sequencing of the clones isolated as described above gave the full-length DNA sequence for PRO1347 and the derived protein sequence for PRO1347.

The entire coding sequence of PRO1347 is shown in FIG. 91 (SEQ ID NO:147). Clone DNA64950-1590 contains a single open reading frame with an apparent translational initiation site at nucleotide positions 183–185, and an apparent stop codon at nucleotide positions 1683–1685 of SEQ ID NO:147. The predicted polypeptide precursor is 500 amino acids long. The signal peptide is at about amino acids 1–17 and the transmembrane domain is at about 239–255 of SEQ ID NO:148. Clone DNA64950-1590 has been deposited with ATCC and is assigned ATCC deposit no. 203224. The full-length PRO1347 protein shown in FIG. 92 has an estimated molecular weight of about 56,748 daltons and a pI of about 8.5.

An analysis of the Dayhoff database (version 35.45 SwissProt 35), using a WU-BLAST2 sequence alignment analysis of the full-length sequence shown in FIG. 92 (SEQ ID NO:148), revealed sequence identity between the PRO1347 amino acid sequence and the following Dayhoff sequences (data incorporated herein): BUTY_HUMAN, AF033107_1, HSU90142_1, HSU90144_1, HSB73_1, HS111M5_2, RO52_HUMAN, AF018080_1, HSAJ03147_4, and MOG_MOUSE.

Example 50

Isolation of cDNA Clones Encoding Human PRO1305

A consensus DNA sequence was assembled relative to other EST sequences using phrap as described in Example 1 above. This consensus sequence is herein designated DNA38103. Based on the DNA38103 consensus sequence, oligonucleotides were synthesized: 1) to identify by PCR a cDNA library that contained the sequence of interest, and 2) for use as probes to isolate a clone of the full-length coding sequence for PRO1305.

PCR primers (forward and reverse) were synthesized:
forward PCR primer (38103.f1)
5'-AACTGCTCTGTGGTTGGAAGCCTG-3' (SEQ ID NO:154)
reverse PCR primer (38103.r1)
5'-CAGTCACATGGCTGACAGACCCAC-3' (SEQ ID NO:155)
Additionally, a synthetic oligonucleotide hybridization probe was constructed from the consensus DNA38103 sequence which had the following nucleotide sequence
hybridization probe (38103.p1)
5'-AGGTTATCAGGGGCTTCACTGTGAAACCTGCAAAGAGG-3' (SEQ ID NO:156)

In order to screen several libraries for a source of a full-length clone, DNA from the libraries was screened by PCR amplification with the PCR primer pair identified above. A positive library was then used to isolate clones encoding the PRO1305 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1305 (designated herein as DNA64952-1568 [FIG. 93, SEQ ID NO:152]; and the derived protein sequence for PRO1305.

The entire nucleotide sequence of DNA64952-1568 is shown in FIG. 93 (SEQ ID NO:152). Clone DNA64952-1568 contains a single open reading frame with an apparent translational initiation site at nucleotide positions 126–128 and ending at the stop codon at nucleotide positions 900–902 (FIG. 93). The predicted polypeptide precursor is 258 amino acids long (FIG. 94). The full-length PRO1305 protein shown in FIG. 94 has an estimated molecular weight of about 25,716 daltons and a pI of about 8.13. Analysis of the full-length PRO1305 sequence shown in FIG. 94 (SEQ ID NO:153) evidences the presence of the following: a signal peptide from about amino acid 1 to about amino acid 25, potential N-glycosylation sites from about amino acid 30 to about amino acid 33, from about amino acid 172 to about amino acid 175, from about amino acid 195 to about amino acid 198, from about amino acid 208 to about amino acid 211 and from about amino acid 235 to about amino acid 238 and an EGF-like domain cysteine pattern signature sequence from about amino acid 214 to about amino acid 225. Clone DNA64952-1568 has been deposited with ATCC on Sep. 15, 1998 and is assigned ATCC deposit no. 203222.

An analysis of the Dayhoff database (version 35.45 SwissProt 35), using a WU-BLAST2 sequence alignment analysis of the full-length sequence shown in FIG. 94 (SEQ ID NO:153), evidenced significant homology between the PRO1305 amino acid sequence and the following Dayhoff sequences: CET22A3_7, LMA2_MOUSE, AF055580_1, AF016903_1, LMB2_MOUSE, P_R71730, LMB3_MOUSE, LMG1_HUMAN, LMG1_DROME and LMA5_MOUSE. As such, the PRO1305 polypeptide does show homology to laminin and may be a laminin homolog.

Example 51

Isolation of cDNA Clones Encoding Human PRO1273

An expressed sequence tag (EST) DNA database (LIFESEQ®, Incyte Pharmaceuticals, Palo Alto, Calif.) was searched and an EST was identified. This sequence was blasted against public databases and Incyte's database. The search was performed using the computer program BLAST or BLAST2 [Altschul et al., *Methods in Enzymology*, 266:460–480 (1996)] as a comparison of the extracellular domain (ECD) protein sequences to a 6 frame translation of the EST sequences. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.).

A consensus DNA sequence was assembled relative to other EST sequences using repeated cycles of BLAST and phrap. This consensus sequence is designated herein "DNA60747". Based on the DNA60747 consensus sequence and its relation to a sequence within the assembly of aligned sequences, Incyte clone 3541105 was purchased and sequenced in full. This Incyte clone came from a library constructed of RNA isolated from seminal vesicle tissue.

The entire coding sequence of PRO1273 is shown in FIG. 95 (SEQ ID NO:157). Clone DNA65402-1540 contains a single open reading frame with an apparent translational initiation site at nucleotide positions 26–28 and an apparent stop codon at nucleotide positions 515–517 of SEQ ID NO:157. The predicted polypeptide precursor is 163 amino acids long. The signal peptide is at about amino acids 1–20 and the conserved region in lipocalins is at about amino acids 25–36 of SEQ ID NO:158. Clone DNA65402-1540 has been deposited with ATCC and is assigned ATCC deposit no. 203252. The full-length PRO1273 protein shown in FIG. 96 has an estimated molecular weight of about 18,045 daltons and a pI of about 4.87.

An analysis of the Dayhoff database (version 35.45 SwissProt 35), using a WU-BLAST2 sequence alignment analysis of the full-length sequence shown in FIG. 96 (SEQ ID NO:158), revealed sequence identity between the PRO1273 amino acid sequence and the following Dayhoff sequences (information from database incorporated herein): PGHD_

FELCA (prostaglandin-h2 d-isomerase precursor), S57748 (prostaglandin D synthetase precursor), LIPO_BUFMA (lipocalin precursor), S52354, QSP_CHICK, ECP19_1, LACB_CAPHI, OLFA_RANPI, D87752_1, and LACB_BOVIN.

Example 52

Isolation of cDNA Clones Encoding Human PRO1302

A consensus DNA sequence encoding PRO1302 was assembled relative to other EST sequences using repeated cycles of phrap as described in Example 1 above. This consensus sequence is designated herein "DNA28742". Based on the DNA28742 consensus sequence, the assembly from which the consensus sequence was derived and other information and discoveries provided herein, the Incyte clone 3344926 (from a diseased spleen tissue library) was purchased and sequenced in full. Sequencing provided the full-length DNA sequence for PRO1302 and the derived protein sequence for PRO1302.

The entire coding sequence of PRO1302 is shown in FIG. 97 (SEQ ID NO:159). Clone DNA65403-1565 contains a single open reading frame with an apparent translational initiation site at nucleotide positions 4345 and an apparent stop codon at nucleotide positions 1432–1435 of SEQ ID NO:159. The predicted polypeptide precursor is 463 amino acids long. The signal peptide is at about amino acids 1–15 and the transmembrane sequence is at about amino acids 351–370 of SEQ ID NO:160. Clone DNA65403-1565 has been deposited with the ATCC and is assigned ATCC deposit no. 203230. The full-length PRO1302 protein shown in FIG. 98 has an estimated molecular weight of about 50,082 daltons and a pI of about 7.3.

An analysis of the Dayhoff database (version 35.45 SwissProt 35), using a WU-BLAST2 sequence alignment analysis of the full-length sequence shown in FIG. 98 (SEQ ID NO:160), revealed sequence identity between the PRO1302 amino acid sequence and the following Dayhoff sequences (data incorporated herein): D86358_1, D86359_1, S71403_1, MAG_HUMAN, JH0593, MMSIAL2_1, C22A_HUMAN, PGBM_HUMAN, PGBM_HUMAN, LACH_DROME, and KMLS_HUMAN.

Example 53

Isolation of cDNA Clones Encoding Human PRO1283

A consensus DNA sequence was assembled relative to other EST sequences using phrap as described in Example 1 above. This consensus sequence is herein designated DNA28753. Based on the DNA28753 consensus sequence, oligonucleotides were synthesized: 1) to identify by PCR a cDNA library that contained the sequence of interest, and 2) for use as probes to isolate a clone of the full-length coding sequence for PRO1283.

PCR primers (forward and reverse) were synthesized:
forward PCR primer (28753. f1)
5'-GGAGATGAAGACCCTGTTCCTG-3' (SEQ ID NO:163)
forward PCR primer (28753. f11)
5'-GGAGATGAAGACCCTGTTCCTGGGTG-3' (SEQ ID NO:164)
reverse PCR primer (28753. r1)
5'-GTCCTCCGGAAAGTCCTTATC-3' (SEQ ID NO:165)
reverse PCR primer (28753. r11)
5'-GCCTAGTGTTCGGGAACGCAGCTTC-3' (SEQ ID NO:166)

Additionally, a synthetic oligonucleotide hybridization probe was constructed from the consensus DNA28753 sequence which had the following nucleotide sequence
hybridization probe (28753. p1)
5'-CAGGGACCTGGTACGTGAAGGCCATGGTGGTCG ATAAGGACTTTCCGGAG-3' (SEQ ID NO:167)
hybridization probe (28753. p11)
5'-CTGTCCTTCACCCTGGAGGAGGAGGATATCACA GGGACCTGGTAC-3' (SEQ ID NO:168)

In order to screen several libraries for a source of a full-length clone, DNA from the libraries was screened by PCR amplification with the PCR primer pair identified above. A positive library was then used to isolate clones encoding the PRO1283 gene using the probe oligonucleotide and one of the PCR primers. RNA for construction of the cDNA libraries was isolated from human breast tumor tissue.

DNA sequencing of the clones isolated as described above gave the full-length DNA sequence for PRO1283 (designated herein as DNA65404-1551 [FIG. 99, SEQ ID NO:161]; and the derived protein sequence for PRO1283.

The entire nucleotide sequence of DNA65404-1551 is shown in FIG. 99 (SEQ ID NO:161). Clone DNA65404-1551 contains a single open reading frame with an apparent translational initiation site at nucleotide positions 45–47 and ending at the stop codon at nucleotide positions 555–557 (FIG. 99). The predicted polypeptide precursor is 170 amino acids long (FIG. 100). The full-length PRO1283 protein shown in FIG. 100 has an estimated molecular weight of about 19,457 daltons and a pI of about 9.10. Analysis of the full-length PRO1283 sequence shown in FIG. 100 (SEQ ID NO:162) evidences the presence of the following: a signal peptide from about amino acid 1 to about amino acid 17. Clone DNA65404-1551 has been deposited with ATCC on Sep. 9, 1998 and is assigned ATCC deposit no. 203244 An analysis of the Dayhoff database (version 35.45 SwissProt 35), using a WU-BLAST2 sequence alignment analysis of the full-length sequence shown in FIG. 100 (SEQ ID NO:162), evidenced significant homology between the PRO1283 amino acid sequence and the following Dayhoff sequences: A40464, VEGP_HUMAN, ALL1_CANFA, LALP_TRIVU, S51803, XELPDS_1, LIPO_BUFMA, S52354, QSP_CHICK and ERBP_RAT.

Example 54

Isolation of cDNA Clones Encoding Human PRO1279

A consensus DNA sequence was assembled relative to other EST sequences using phrap as described in Example 1 above. This consensus sequence is herein designated DNA30856. Based on the DNA30856 consensus sequence, oligonucleotides were synthesized: 1) to identify by PCR a cDNA library that contained the sequence of interest, and 2) for use as probes to isolate a clone of the full-length coding sequence for PRO1279.

PCR primers (forward and reverse) were synthesized:
forward PCR primer (30856. f1)
5'-GGCTGCGGGACTGGAAGTCATCGGG-3' (SEQ ID NO:171)
forward PCR primer (30856. f11)
5'-CTCCAGGCCATGAGGATTCTGCAG-3' (SEQ ID NO:172)
forward PCR primer (30856. f12)
5'-CCTCTGGTCTGTAACCAG-3' (SEQ ID NO:173)
reverse PCR primer (30856. r1)
5'-TCTGTGATGTTGCCGGGGTAGGCG-3' (SEQ ID NO:174)

reverse PCR primer (30856. r11) 5'-CGTGTAGACACCAGGCTTTCGGGTG-3' (SEQ ID NO:175)
reverse PCR primer (30856. r12) 5'-CCCTTGATGATCCTGGTC-3' (SEQ ID NO:176)

Additionally, synthetic oligonucleotide hybridization probes were constructed from the consensus DNA30856 sequence which had the following nucleotide sequences
hybridization probe (30856.p1) 5'-AGGCCATGAGGATTCTGCAGTTAATCCTGCTTGCTCTGGCAACAGGGCTT-3' (SEQ ID NO:177)
hybridization probe (30856. p11) 5'-GAGAGACCAGGATCATCAAGGGGTTCGAGTGCAAGCCTCACTC-3' (SEQ ID NO:178)

In order to screen several libraries for a source of a full-length clone, DNA from the libraries was screened by PCR amplification with the PCR primer pair identified above. A positive library was then used to isolate clones encoding the PRO1279 gene using the probe oligonucleotide and one of the PCR primers. RNA for construction of the cDNA libraries was isolated from human lung tumor tissue.

DNA sequencing of the clones isolated as described above gave the full-length DNA sequence for PRO1279 (designated herein as DNA65405-1547 [FIG. 101, SEQ ID NO:169]; and the derived protein sequence for PRO1279.

The entire nucleotide sequence of DNA65405-1547 is shown in FIG. 101 (SEQ ID NO:169). Clone DNA65405-1547 contains a single open reading frame with an apparent translational initiation site at nucleotide positions 106–108 and ending at the stop codon at nucleotide positions 856–858 (FIG. 101). The predicted polypeptide precursor is 250 amino acids long (FIG. 102). The full-length PRO1279 protein shown in FIG. 102 has an estimated molecular weight of about 27,466 daltons and a pI of about 8.87. Analysis of the full-length PRO1279 sequence shown in FIG. 102 (SEQ ID NO:170) evidences the presence of the following: a signal peptide from about amino acid 1 to about amino acid 18, a serine protease, trypsin family, histidine active site from about amino acid 58 to about amino acid 63, potential N-glycosylation sites from about amino acid 99 to about amino acid 102, from about amino acid 165 to about amino acid 168, from about amino acid 181 to about amino acid 184 and from about amino acid 210 to about amino acid 213, a glycosaminoglycan attachment site from about amino acid 145 to about amino acid 148, amino acid sequence blocks present in kringle domain proteins from about amino acid 197 to about amino acid 209 and from about amino acid 47 to about amino acid 64, amino acid sequence blocks having homology to serine protease, trypsin family, histidine proteins from about amino acid 199 to about amino acid 209, from about amino acid 47 to about amino acid 63 and from about amino acid 220 to about amino acid 243 and amino acid sequence blocks having homology to apple domain proteins from about amino acid 222 to about amino acid 249 and from about amino acid 189 to about amino acid 222. Clone DNA65405-1547 has been deposited with ATCC on Nov. 17, 1998 and is assigned ATCC deposit no.203476.

An analysis of the Dayhoff database (version 35.45 SwissProt 35), using a WU-BLAST2 sequence alignment analysis of the full-length sequence shown in FIG. 102 (SEQ ID NO:170), evidenced significant homology between the PRO1279 amino acid sequence and the following Dayhoff sequences: I56559, S55066, KLK7_RAT, KLK1_RAT, KLKB_RAT, KLK3_MOUSE, KLK8_RAT, AF013988_1, D78203_1 and HSU62801_1.

Additionally, DNA65405-1547 was obtained by purchasing the Incyte EST clone no. 2723646 and sequencing the insert of that clone, thereby giving the DNA65405-1547 sequence shown in FIG. 101 (SEQ ID NO:169).

Example 55

Isolation of cDNA Clones Encoding Human PRO1304

A consensus DNA sequence was assembled relative to other EST sequences using phrap as described in Example 1 above. This consensus sequence is herein designated DNA35745. Based on the DNA35745 consensus sequence, oligonucleotides were synthesized: 1) to identify by PCR a cDNA library that contained the sequence of interest, and 2) for use as probes to isolate a clone of the full-length coding sequence for PRO1304.

PCR primers (forward and reverse) were synthesized:
forward PCR primer (35745. f1) 5'-GTGTTCTGCTGGAGCCGATGCC-3' (SEQ ID NO:181)
forward PCR primer (35745. f2) 5'-GACATGGACAATGACAGG-3' (SEQ ID NO:182)
forward PCR primer (35745. f3) 5'-CCTTTCAGGATGTAGGAG-3' (SEQ ID NO:183)
forward PCR primer (35745. f4) 5'-GATGTCTGCCACCCCAAG-3' (SEQ ID NO:184)
reverse PCR primer (35745. r1) 5'-GCATCCTGATATGACTTGTCACGTGGC-3' (SEQ ID NO:185)
reverse PCR primer (35745. r2) 5'-TACAAGAGGGAAGAGGAGTTGCAC-3' (SEQ ID NO:186)

Additionally, a synthetic oligonucleotide hybridization probe was constructed from the consensus DNA35745 sequence which had the following nucleotide sequence
hybridization probe (35745.p1) 5'-GCCCATTATGACGGCTACCTGGCTAAAGACGGCTCGAAATTCTACTGCAGCC-3' (SEQ ID NO:187)

In order to screen several libraries for a source of a full-length clone, DNA from the libraries was screened by PCR amplification with the PCR primer pair identified above. A positive library was then used to isolate clones encoding the PRO1304 gene using the probe oligonucleotide and one of the PCR primers. RNA for construction of the cDNA libraries was isolated from human ovary tissue.

DNA sequencing of the clones isolated as described above gave the full-length DNA sequence for PRO1304 (designated herein as DNA65406-1567 [FIG. 103, SEQ ID NO:179]; and the derived protein sequence for PRO1304.

The entire nucleotide sequence of DNA65406-1567 is shown in FIG. 103 (SEQ ID NO:179). Clone DNA65406-1567 contains a single open reading frame with an apparent translational initiation site at nucleotide positions 23–25 and ending at the stop codon at nucleotide positions 689–691 (FIG. 103). The predicted polypeptide precursor is 222 amino acids long (FIG. 104). The full-length PRO1304 protein shown in FIG. 104 has an estimated molecular weight of about 25,794 daltons and a pI of about 6.24. Analysis of the full-length PRO1304 sequence shown in FIG. 104 (SEQ ID NO:180) evidences the presence of the following: an endoplasmic reticulum targeting sequence from about amino acid 219 to about amino acid 222, a potential N-glycosylation site from about amino acid 45 to about amino acid 48, FKBP-type peptidyl-prolyl cis-trans isomerase homology blocks from about amino acid 87 to about amino acid 123 and from about amino acid 129 to about amino acid 142 and EF-hand calcium binding domain protein homology blocks from about amino acid 202 to about amino acid 214 and from about amino acid 195 to about amino acid 214. Clone DNA65406-1567 has been deposited with ATCC on Sep. 15, 1998 and is assigned ATCC deposit no. 203219.

An analysis of the Dayhoff database (version 35.45 SwissProt 35), using a WU-BLAST2 sequence alignment analysis of the full-length sequence shown in FIG. 104 (SEQ ID NO:180), evidenced significant homology between the PRO1304 amino acid sequence and the following Dayhoff sequences: AF040252_1, P_R28980, S71238, CELC05C8_1, VFU52045_1, S75144, FKB3_BOVIN, CELC50F2_6, CELB0511_12 and P_R41781.

The DNA65406-1567 sequence was also obtained by isolating and sequencing the insert of Incyte EST clone no. 2813577.

Example 56

Isolation of cDNA Clones Encoding Human PRO1317

Using the technique described in Example 1 above, Incyte EST no. 33598 was identified as a sequence of interest having a BLAST score of 70 or greater that did not encode a known protein. The sequence of Incyte EST no. 33598 is designated herein as "DNA36958". Based on the DNA36958 sequence, oligonucleotides can be synthesized: 1) to identify by PCR a cDNA library that contains the sequence of interest, and 2) for use as probes to isolate a clone of the full-length coding sequence for PRO1317.

The following are suitable PCR primers (forward and reverse) that can be synthesized based on the DNA36958 sequence:
forward PCR primer: AGGGACCATTGCTTCTTCCAG-GCC (36958. f1; SEQ ID NO:190)
reverse PCR primer: CGTTACATGTCTCCAAGGG-GAATG (36958. r1; SEQ ID NO:191)

Additionally, a synthetic oligonucleotide hybridization probe can be constructed from the consensus DNA36958 sequence having the following nucleotide sequence:
hybridization probe: CCTGTGCTAAGTGCCCCCCAAAT-GCTTCCTGTGTCAATAACACTCACTGC (36958.p1; SEQ ID NO:192)

In order to screen several libraries for a source of a full-length clone, DNA from the libraries is screened by PCR amplification with the PCR primer pair identified above. A positive library is then used to isolate clones encoding the PRO1317 gene using the probe oligonucleotide and one of the PCR primers. RNA for construction of the cDNA libraries can be isolated from tissue containing the sequence of interest, for example from peripheral blood, particularly blood taken from a patient having a high leukocyte count (e.g hypereosinophilia).

The full-length DNA sequence for PRO1317, designated herein as DNA65408-1578 (FIG. 105; SEQ ID NO:188) was obtained by purchasing Incyte EST no. 335958, obtaining the cDNA insert, and sequencing it in its entirety. Incyte clone no. 335958 originated from a library constructed using RNA isolated from peripheral blood cells apheresed from a male patient afflicted with hypereosinophilia.

The entire coding sequence of PRO1317 is shown in FIG. 105 (SEQ ID NO:188). Clone DNA65408-1578 contains a single open reading frame with an apparent translational initiation site at nucleotide positions 6–8 and an apparent stop codon at nucleotide positions 228–230. The predicted polypeptide precursor is 74 amino acids long. The full-length PRO1317 protein shown in FIG. 106 has an estimated molecular weight of about 7,831 daltons and a pI of about 9.08. Additional features include: a signal peptide at about amino acids 1–18, potential N-glycosylation sites at about amino acids 34–37 and 39–42, and a microbodies C-terminal targeting signal at amino acids 72–74.

An analysis of the Dayhoff database (version 35.45 SwissProt 35), using a WU-BLAST2 sequence alignment analysis of the full-length sequence shown in FIG. 106 (SEQ ID NO:189), revealed significant homology between the PRO1317 amino acid sequence and the Dayhoff sequence designated CD97_HUMAN. Additionally, some homology was found between the PRO1317 amino acid sequence and the following Dayhoff sequences: GEN12618, CELZK783_1, G156_PARPR, GIAVSPE_1, AF040387_1, S78059, I50617, XLSEK1_1, and NEL2_RAT.

Clone DNA65408-1578 was deposited with the ATCC on Sep. 15, 1998, and is assigned ATCC deposit no. 203217.

Example 57

Isolation of cDNA Clones Encoding Human PRO1303

A consensus DNA sequence was assembled relative to other EST sequences using phrap as described in Example 1 above. This consensus sequence is designated herein "DNA47347". Based on the DNA47347 consensus sequence and its homology to an Incyte EST within the assembly from which DNA47347 was derived, Incyte clone 1430305 (from an ileum tissue library) was purchased and sequenced in full. The sequence encoding PRO1303 was thereby identified.

The entire coding sequence of PRO1303 is shown in FIG. 107 (SEQ ID NO:193). Clone DNA65409-1566 contains a single open reading frame with an apparent translational initiation site at nucleotide positions 121–123 and an apparent stop codon at nucleotide positions 865–867. The predicted polypeptide precursor is 248 amino acids long. The signal peptide is at about amino acids 1–17 of SEQ ID NO:194. The locations of N-glycosylation sites, active and conserved regions and domains are further indicated in FIG. 194. Clone DNA65409-1566 has been deposited with ATCC and is assigned ATCC deposit no. 203232. The full-length PRO1303 protein shown in FIG. 108 has an estimated molecular weight of about 26,734 daltons and a pI of about 7.9.

An analysis of the Dayhoff database (version 35.45 SwissProt 35), using a WU-BLAST2 sequence alignment analysis of the full-length sequence shown in FIG. 108 (SEQ ID NO:194), revealed sequence identity between the PRO1303 amino acid sequence and the following Dayhoff sequences (data incorporated herein): AB009849_1, P_W08475, AF024605_1, A42048_1, TRY3_RAT, MMAE00066414, TRY1_RAT, MMAE000663_4, MMAE000665_2, and MMAE00066412.

Example 58

Isolation of cDNA Clones Encoding Human PRO1306

Using the method described in Example 1 above, Incyte EST No. 2449282, also referred to herein as DNA5918, was identified as a sequence of interest having a BLAST score of 70 or greater that did not encode a known protein. From the DNA5918 sequence, a consensus sequence was assembled using BLAST and the program "phrap" (Phil Green, University of Washington, Seattle, Wash.). This consensus sequence is designated herein as "DNA47399". Based on the DNA47399 consensus sequence, oligonucleotides can be synthesized: 1) to identify by PCR a cDNA library that contains the sequence of interest, and 2) for use as probes to isolate a clone of the full-length coding sequence for PRO1306.

The entire coding sequence of PRO1306 shown in FIG. 109 (SEQ ID NO:195), was obtained by purchasing Incyte EST no. 2449282, obtaining the cDNA insert and sequencing it in its entirety. Clone DNA65410-1569 contains a single open reading frame with an apparent translational initiation site at nucleotide positions 106–108 and an apparent stop codon at nucleotide positions 556–558. The predicted polypeptide precursor is 150 amino acids long. The full-length PRO1306 protein shown in FIG. 110 has an estimated molecular weight of about 17,068 daltons, a pI of about 7.29, and a potential N-glycosylation site at about amino acids 131–134.

An analysis of the Dayhoff database (version 35.45 SwissProt 35), using a WU-BLAST2 sequence alignment analysis of the full-length sequence shown in FIG. 110 (SEQ ID NO:196), revealed significant homology between the PRO1306 amino acid sequence and Dayhoff sequence AIF1_HUMAN. Homology was also shown between the PRO1306 amino acid sequence and the following Dayhoff sequences: JC4902, BAR1_RAT, AF020281_1, HSU95213_1, TCH3_ARATH, LEY14765_1, CATR_NAEGR, S35185, and AF065247_1.

Clone DNA65410-1569, was deposited with the ATCC on Sep. 15, 1998 and is assigned ATCC deposit no. 203231.

Example 59

Isolation of cDNA Clones Encoding Human PRO1336

An EST sequence was identified and entered into a proprietary Genentech database. The EST was blasted against various EST databases. The EST databases included public EST databases (e.g., GenBank), and a proprietary EST database (LIFESEQ®, Incyte Pharmaceuticals, Palo Alto, Calif.), and proprietary ESTs from Genentech. The search was performed using the computer program BLAST or BLAST2 [Altschul et al., Methods in Enzymology, 266:460–480 (1996)] as a comparison of the ECD protein sequences to a 6 frame translation of the EST sequences. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.).

A consensus DNA sequence encoding PRO1336 was assembled relative to other aligned EST sequences (forming an assembly) using phrap. This consensus sequence is designated herein "DNA43319". Based on the DNA43319 consensus sequence, oligonucleotides were synthesized: 1) to identify by PCR a cDNA library that contained the sequence of interest, and 2) for use as probes to isolate a clone of the full-length coding sequence for PRO1336.

PCR primers (forward and reverse) were synthesized:
forward PCR primer 5'ATGGAGATTCCTGCCAACTTGCCG3' (SEQ ID NO:199); and
reverse PCR primer 5'TTGTTGGCATTGAGGAGGAGCAGC3' (SEQ ID NO:200).

Additionally, a synthetic oligonucleotide hybridization probe was constructed from the consensus DNA43319 sequence which had the following nucleotide sequence:
hybridization probe 5'GAGGGCATCGTCGAAATACGCCTAGAACAGAACTCCATCAAAGCCATCCC3' (SEQ ID NO:201).

In order to screen several libraries for a source of a full-length clone, DNA from the libraries was screened by PCR amplification with the PCR primer pair identified above. A positive library was then used to isolate clones encoding the PRO1336 gene using the probe oligonucleotide and one of the PCR primers. RNA for construction of the cDNA libraries was isolated from human fetal lung tissue.

DNA sequencing of the clones isolated as described above gave the full-length DNA sequence for PRO1336 (designated herein as DNA65423-1595 [FIGS. 111A–B, SEQ ID NO:198]; and the derived protein sequence for PRO1336.

The entire coding sequence of PRO1336 is shown in FIGS. 111A–B (SEQ ID NO:198). Clone DNA65423-1595 contains a single open reading frame with an apparent translational initiation site at nucleotide positions 83–85 and an apparent stop codon at nucleotide positions 46524654 of SEQ ID NO:198. The predicted polypeptide precursor is 1523 amino acids long. The approximate locations of the signal peptide (amino acids 1–27), aspartic acid and asparagine hydroxylation sites, EGF-like domain cystein pattern signature regions, a leucine zipper pattern region, a region conserved in immunoglobulins and major histocompatibility complexes, and N-glycosylation sites are indicated in FIG. 112. Clone DNA65423-1595 has been deposited with the ATCC and is assigned ATCC deposit no. 203227. The full-length PRO1336 protein shown in FIG. 112 has an estimated molecular weight of about 167,715 daltons and a pI of about 8.06.

An analysis of the Dayhoff database (version 35.45 SwissProt 35), using a WU-BLAST2 sequence alignment analysis of the full-length sequence shown in FIG. 112 (SEQ ID NO:198), revealed sequence identity between the PRO1336 amino acid sequence and the following Dayhoff sequences (data incorporated herein): SLIT_DROME, CEF40E10_1, LCU58977_1, AF029779_1, FBP1_STRPU, NOTC_XENLA, AC004663_1, XELXDEL_1, P_W05835 and HSU77720_1.

Example 60

Isolation of cDNA Clones Encoding Human PRO1278

A consensus DNA sequence was assembled relative to other EST sequences using phrap as described in Example 1 above. This consensus sequence is designated herein "Consen5230". In addition, the Consen5230 consensus sequence was extended using repeated cycles of BLAST and phrap to extend the consensus sequence as far as possible using the sources of EST sequences discussed above. The extended consensus sequence is designated herein as "DNA44801". Based on the DNA44801 consensus sequence, oligonucleotides were synthesized: 1) to identify by PCR a cDNA library that contained the sequence of interest, and 2) for use as probes to isolate a clone of the full-length coding sequence for PRO1278.

PCR primers (forward and reverse) were synthesized:
forward PCR primers: GCAGGCTTTGAGGATGAAGGCTGC (44801. f1; SEQ ID NO:204) and CTCATTGGCTGCCTGGTCACAGGC (44801. f2; SEQ ID NO:205)
reverse PCR primers: CCAGTCGGACAGGTCTCTCCCCTC (44801. r1; SEQ ID NO:206) and TCAGTGACCAAGGCTGAGCAGGCG (44801. r2; SEQ ID NO:207)

Additionally, a synthetic oligonucleotide hybridization probe was constructed from the consensus DNA44801 sequence which had the following nucleotide sequence:
hybridization probe: CTACACTCGTTGCAAA CTGGCAAAAATATTCTCGAGGGCTGGCCTGG (44801.p1; SEQ ID NO:208)

In order to screen several libraries for a source of a full-length clone, DNA from the libraries was screened by PCR amplification with the PCR primer pair identified above. A positive library was then used to isolate clones encoding the PRO1278 gene using the probe oligonucleotide and one of the PCR primers. RNA for construction of the cDNA libraries was isolated from human testis.

DNA sequencing of the clones isolated as described above gave the full-length DNA sequence for PRO1278 (designated herein as DNA66304-1546 [FIG. 113, SEQ ID NO:202]; and the derived protein sequence for PRO1278.

The entire coding sequence of PRO1278 is shown in FIG. 113 (SEQ ID NO:202). Clone DNA66304-1546 contains a single open reading frame with an apparent translational initiation site at nucleotide positions 141–143 and an apparent stop codon at nucleotide positions 585–587. The predicted polypeptide precursor is 148 amino acids long. The full-length PRO1278 protein shown in FIG. 114 has an estimated molecular weight of about 16,623 daltons and a pI of about 8.47. Additional features include a signal peptide sequence at about amino acids 1–19; a potential N-glycosylation site at about amino acids 58–61; an alpha-lactalbumin/lysozyme C signature at about amino acids 94–112; and homolgy with alpha-lactalbumin/lysozyme C at about amino acids 35–59, 67–59 and 112–133.

An analysis of the Dayhoff database (version 35.45 SwissProt 35), using a WU-BLAST2 sequence alignment analysis of the full-length sequence shown in FIG. 114 (SEQ ID NO:203), revealed significant homology between the PRO1278 amino acid sequence and the following Dayhoff sequences: LYC1_ANAPL, LYC3_ANAPL, and LYC_HUMAN.

Clone DNA66304-1546 was deposited with the ATCC on Oct. 6, 1998, and is assigned ATCC deposit no. 203321.

Example 61

Isolation of cDNA Clones Encoding Human PRO1298

Use of the signal sequence algorithm described in Example 3 above allowed identification of an EST cluster sequence from an Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a diseased prostate tissue library. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56389.

In light of the sequence homology between the DNA56389 sequence and an EST sequence contained within an Incyte EST within the assembly from with the consensus sequence was derived, Incyte clone 3355717 was purchased and the cDNA insert was obtained and sequenced. The sequence of this cDNA insert is shown in FIG. 115 and is herein designated as DNA66511-1563.

The full length clone shown in FIG. 115 contained a single open reading frame with an apparent translational initiation site at nucleotide positions 94–96 and ending at the stop codon found at nucleotide positions 1063–1065 (FIG. 115; SEQ ID NO:209). The predicted polypeptide precursor (FIG. 116, SEQ ID NO:210) is 323 amino acids long. The signal peptide is at about amino acids 1–15 of SEQ ID NO:210. PRO1298 has acalculated molecular weight of approximately 37,017 daltons and an estimated pI of approximately 8.83. Clone DNA66511-1563 was deposited with the ATCC on Sep. 15, 1998 and is assigned ATCC deposit no. 203228.

An analysis of the Dayhoff database (version 35.45 SwissProt 35), using a WU-BLAST2 sequence alignment analysis of the full-length sequence shown in FIG. 116 (SEQ ID NO:210), revealed sequence identity between the PRO1298 amino acid sequence and the following Dayhoff sequences (data incorporated herein): ALG2_YEAST, CAPM_STAAU, C69098, C69255, SUS2_MAIZE, A69143, S74778, AB009527_13, AF050103_2 and BBA224769_1.

Example 62

Isolation of cDNA Clones Encoding Human PRO1301

Use of the signal sequence algorithm described in Example 3 above allowed identification of an EST cluster sequence from the LIFESEQ®database, designated Incyte Cluster No. 93492, also referred herein as "DNA10591". This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). One or more of the ESTs was derived from a cDNA library constructed from RNA isolated from lung tissue removed from a male with adenocarcinoma. The consensus sequence obtained therefrom is herein designated "DNA57725".

In light of the sequence homology between the DNA57725 sequence and an EST sequence contained within the EST no. 3395984, the EST clone 3395984 was purchased and the cDNA insert was obtained and sequenced in its entirety. The sequence of this cDNA insert is shown in FIG. 117 and is herein designated as "DNA66512-1564".

The full length clone shown in FIG. 117 contained a single open reading frame with an apparent translational initiation site at nucleotide positions 43 to 45 and ending at the stop codon found at nucleotide positions 1429 to 1431 (FIG. 117; SEQ ID NO:211). The predicted polypeptide precursor (FIG. 118, SEQ ID NO:212) is 462 amino acids long. Other features of the PRO1301 protein include: a signal sequence at about amino acids 1–18; a transmembrane domain at about amino acids 271–290; a cytochrome P450 homologous region at about amino acids 134–462; and potential N-glycosylation sites at about amino acids 94–97, 217–220, and 246–249. PRO1301 has a calculated molecular weight of approximately 52,432 daltons and an estimated pI of approximately 6.14. Clone DNA66512-1564 was deposited with the ATCC on Sep. 15, 1998 and is assigned ATCC deposit no. 203218.

An analysis of the Dayhoff database (version 35.45 SwissProt 35), using a WU-BLAST2 sequence alignment analysis of the full-length sequence shown in FIG. 118 (SEQ ID NO:212), revealed some homology between the PRO1301 amino acid sequence and the following Dayhoff sequences: PSU29243_1, A69975, ATAC00448418, D78607_1, CEB0331_1, HUMCYTIIIA_1, AF014800_1, CELT13C5_4, CELC45H4_14, and CEC54E10_1.

Example 63

Isolation of cDNA Clones Encoding Human PRO1268

Use of the signal sequence algorithm described in Example 3 above allowed identification of an EST cluster sequence from the LIFESEQ® database, designated EST No. 8879. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). One or more of the ESTs was derived from a cDNA library constructed from human brain tumor tissue taken from a cerebral meninges lesion. The consensus sequence obtained therefrom is herein designated DNA56258.

In light of the sequence homology between the DNA56258 sequence and an EST sequence contained within the Incyte EST no. 2944541, EST clone no. 2944541 was purchased and the cDNA insert was obtained and sequenced. The sequence of this cDNA insert is shown in FIG. 119 and is herein designated as "DNA66519-1535".

The full length clone shown in FIG. 119 contained a single open reading frame with an apparent translational initiation site at nucleotide positions 89 to 91 and ending at the stop codon found at nucleotide positions 509 to 511 (FIG. 119; SEQ ID NO:213). The predicted polypeptide precursor (FIG. 120, SEQ ID NO:214) is 140 amino acids long. PRO1268 has a calculated molecular weight of approximately 15,503 daltons and an estimated pI of approximately 6.44. Additional features include a type II transmembrane domain at about amino acids 12–28; type I transmembrane domains at about amino acids 51–66 and 107–124; a potential N-glycosylation site at about amino acids 79–82, and a region having homology with G-protein coupbled receptors at about amino acids 59–99.

An analysis of the Dayhoff database (version 35.45 SwissProt 35), using a WU-BLAST2 sequence alignment analysis of the full-length sequence shown in FIG. 120 (SEQ ID NO:214), revealed some homology between the PRO1268 amino acid sequence and Dayhoff sequence no. CEF39B2_9. However, the percent sequence identity was determined to not be significant.

Clone DNA66519-1535 was deposited with the ATCC on Sep. 15, 1998 and is assigned ATCC deposit no. 203236.

Example 64

Isolation of cDNA Clones Encoding Human PRO1269

Use of the signal sequence algorithm described in Example 3 above allowed identification of an EST cluster sequence from the LIFESEQ®database, designated EST Cluster No. 101920. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56509.

In light of the sequence homology between the DNA56509 sequence and an EST sequence contained within the EST no. 103157, EST clone no.103157 was purchased and the cDNA insert was obtained and sequenced. The sequence of this cDNA insert is shown in FIG. 121 and is herein designated as DNA66520-1536.

The full length clone shown in FIG. 121 contained a single open reading frame with an apparent translational initiation site at nucleotide positions 26–29 and ending at the stop codon found at nucleotide positions 614–616 (FIG. 121; SEQ ID NO:215). The predicted polypeptide precursor (FIG. 122, SEQ ID NO:216) is 196 amino acids long, with a signal peptide located at about amino acids 1–20. There is a potential N-glycosylation site at about amino acids 112–115. PRO1269 has a calculated molecular weight of approximately 21,731 daltons and an estimated pI of approximately 8.97.

An analysis of the Dayhoff database (version 35.45 SwissProt 35), using a WU-BLAST2 sequence alignment analysis of the full-length sequence shown in FIG. 122 (SEQ ID NO:216), revealed significant homology between the PRO1269 amino acid sequence and the amino acid sequence of Dayhoff sequence no. P_W23722. In addition, sequence homology was found between the PRO1269 amino acid sequences and the amino acid sequences of the following Dayhoff sequences: MMTAG7_1, MTV026_16, NAAA_BPT3, S75616_1, and NCP_PIG.

Clone DNA66520-1536 was deposited with the ATCC on Sep. 15, 1998, and is assigned ATCC deposit no. 203226.

Example 65

Isolation of cDNA Clones Encoding Human PRO1327

Use of the signal sequence algorithm described in Example 3 above allowed identification of an EST cluster sequence fromthe Incyte database, designated Incyte EST cluster sequence no. 173410. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2

(Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56520.

In light of the sequence homology between the DNA56520 sequence and an EST sequence contained within the Incyte EST clone no. 3451760, the Incyte EST clone no. 3451760 was purchased and the cDNA insert was obtained and sequenced. The sequence of this cDNA insert is shown in FIG. 123 and is herein designated as DNA66521-1583.

Clone DNA66521-1583 contains a single open reading frame with an apparent translational initiation site at nucleotide positions 55–57 and ending at the stop codon at nucleotide positions 811–813 (FIG. 123). The predicted polypeptide precursor is 252 amino acids long (FIG. 124). The full-length PRO1327 protein shown in FIG. 124 has an estimated molecular weight of about 28,127 daltons and a pI of about 8.91. Analysis of the full-length PRO1327 sequence shown in FIG. 124 (SEQ ID NO:218) evidences the presence of the following: a signal peptide from about amino acid 1 to about amino acid 14, potential N-glycosylation sites from about amino acid 62 to about amino acid 65, from about amino acid 127 to about amino acid 130, from about amino acid 137 to about amino acid 140 and from about amino acid 143 to about amino acid 146 and a 2-oxo acid dehydrogenase acyltransferase homology block from about amino acid 61 to about amino acid 71. Clone DNA66521-1583 has been deposited with ATCC on Sep. 15, 1998 and is assigned ATCC deposit no. 203225.

An analysis of the Dayhoff database (version 35.45 SwissProt 35), using a WU-BLAST2 sequence alignment analysis of the full-length sequence shown in FIG. 124 (SEQ ID NO:218), evidenced significant homology between the PRO1327 amino acid sequence and the following Dayhoff sequences: NPH1_RAT, NPH2_MOUSE, OTU_DROME, D40750, BB61_RABIT, P_R23873, P_W09643, CAGHMGPA_1, HUMPRP11_1 and S670958_1.

Example 66

Isolation of cDNA Clones Encoding Human PRO1382

Using the method described in Example 1 above, Incyte EST no. 2719 was identified as a sequence of interest having a BLAST score of 70 or greater that does not encode a known protein. The nucleotide sequence of EST no. 2719 is designated herein "DNA42842". Based on the DNA42842 sequence, oligonucleotides were synthesized: 1) to identify by PCR a cDNA library that contained the sequence of interest, and 2) for use as probes to isolate a clone of the full-length coding sequence for PRO1382.

PCR primers (forward and reverse) were synthesized:
forward PCR primer ACGGCTCACCATGGGCTCCG (42842. f1; SEQ ID NO:221)
reverse PCR primer AGGAAGAGGAGCCCTTG-GAGTCCG (42842. r1; SEQ ID NO:222)

Additionally, a synthetic oligonucleotide hybridization probe was constructed from the consensus DNA42842 sequence which had the following nucleotide sequence: hybridization probe CGTGCTGGAGGGCAAGTGTCTG-GTGGTGTGCGACTCGAAC (42842.p1; SEQ ID NO:223).

In order to screen several libraries for a source of a full-length clone, DNA from the libraries was screened by PCR amplification with the PCR primer pair identified above. A positive library was then used to isolate clones encoding the PRO1382 gene using the probe oligonucleotide and one of the PCR primers. RNA for construction of the cDNA libraries was isolated from a human breast carcinoma.

DNA sequencing of the clones isolated as described above gave the full-length DNA sequence for PRO1382 (designated herein as DNA66526-1616 [FIG. 125, SEQ ID NO:219]; and the derived protein sequence for PRO1382.

The entire coding sequence of PRO1382 is shown in FIG. 125 (SEQ ID NO:219). Clone DNA66526-1616 contains a single open reading frame with an apparent translational initiation site at nucleotide positions 337–339 and an apparent stop codon at nucleotide positions 940–942. The predicted polypeptide precursor is 201 amino acids long. The full-length PRO1382 protein shown in FIG. 126 has an estimated molecular weight of about 21,808 daltons and a pI of about 9.04. Additional features include a signal peptide at about amino acids 1–27; potential N-glycosylation sites at about amino acids 29–32 and 88–91; and regions of homology with Clq proteins at about amino acids 92–126, 159–178, and 191–200.

An analysis of the Dayhoff database (version 35.45 SwissProt 35), using a WU-BLAST2 sequence alignment analysis of the full-length sequence shown in FIG. 126 (SEQ ID NO:220), revealed significant homology between the PRO1382 amino acid sequence Dayhoff sequence no. CERL_RAT. Homology was also revealed between the PRO1382 amino acid sequence and the following Dayhoff sequences: CERB_HUMAN, S76975_1, A41752, HUMC1QB2_1, A57131, CA1A_HUMAN, ACR3_MOUSE, and COLE_LEPMA.

Clone DNA66526-1616 has been deposited with ATCC and is assigned ATCC deposit no. 203246.

Example 67

Isolation of cDNA Clones Encoding Human PRO1328

Use of the signal sequence algorithm described in Example 3 above allowed identification of an EST cluster sequence from the Incyte database, designated Incyte EST cluster sequence no. 40671. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56749.

In light of the sequence homology between the DNA56749 sequence and an ESt sequence contained within the Incyte EST clone no. 4111192, the Incyte EST clone no. 4111192 was purchased and the cDNA insert was obtained and sequenced. The sequence of this cDNA insert is shown in FIG. 127 and is herein designated as DNA66658-1584.

Clone DNA66658-1584 contains a single open reading frame with an apparent translational initiation site at nucleotide positions 9–11 and ending at the stop codon at nucleotide positions 780–782 (FIG. 127). The predicted polypeptide precursor is 257 amino acids long (FIG. 128). The full-length PRO1328 protein shown in FIG. 128 has an estimated molecular weight of about 28,472 daltons and a pI of about 9.33. Analysis of the full-length PRO1328 sequence shown in FIG. 128 (SEQ ID NO:225) evidences the presence of the following: a signal peptide from about amino acid 1 to about amino acid 19, transmembrane domains from about amino acid 32 to about amino acid 51, from about amino acid 119 to about amino acid 138, from about amino acid 152 to about amino acid 169 and from about amino acid 216 to about amino acid 235, a glycosaminoglycan attachment site from about amino acid 120 to about amino acid 123 and sodium/nuerotransmitter symporter family protein homology block from about amino acid 31 to about amino acid 65. Clone DNA66658-1584 has been deposited with ATCC on Sep. 15, 1998 and is assigned ATCC deposit no. 203229.

An analysis of the Dayhoff database (version 35.45 SwissProt 35), using a WU-BLAST2 sequence alignment analysis of the full-length sequence shown in FIG. 128 (SEQ ID NO:225), evidenced significant homology between the PRO1328 amino acid sequence and the following Dayhoff sequences: CEVF36H2L_2, TIP2_TOBAC, AB009466_16, ATU39485_1, P_R60153, P_R77082, S73351, C69392, LEU95008_1 and E64667.

Example 68

Isolation of cDNA Clones Encoding Human PRO1325

Use of the signal sequence algorithm described in Example 3 above allowed identification of an EST cluster sequence from the Incyte database, designated Incyte EST cluster sequence no. 139524. This EST cluster sequence was then compared to a variety of expressed sequence tag (EST) databases which included public EST databases (e.g., GenBank) and a proprietary EST DNA database (Lifeseq®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56115.

In light of the sequence homology between the DNA56115 sequence and an EST sequence contained within the Incyte EST clone no. 3744079, the Incyte EST clone no. 3744079 was purchased and the cDNA insert was obtained and sequenced. The sequence of this cDNA insert is shown in FIG. 129 and is herein designated as DNA66659-1593.

Clone DNA66659-1593 contains a single open reading frame with an apparent translational initiation site at nucleotide positions 51–53 and ending at the stop codon at nucleotide positions 2547–2549 (FIG. 129). The predicted polypeptide precursor is 832 amino acids long (FIG. 130). The full-length PRO1325 protein shown in FIG. 130 has an estimated molecular weight of about 94,454 daltons and a pI of about 6.94. Analysis of the full-length PRO1325 sequence shown in FIG. 130 (SEQ ID NO:227) evidences the presence of the following: a signal peptide from about amino acid 1 to about amino acid 18, transmembrane domains from about amino acid 292 to about amino acid 317, from about amino acid 451 to about amino acid 470, from about amino acid 501 to about amino acid 520, from about amino acid 607 to about amino acid 627 from about amino acid 751 to about amino acid 770, a leucine zipper pattern sequence from about amino acid 497 to about amino acid 518 and potential N-glycosylation sites from about amino acid 27 to about amino acid 30, from about amino acid 54 to about amino acid 57, from about amino acid 60 to about amino acid 63, from about amino acid position 123 to about amino acid position 126, from about amino acid position 141 to about amino acid position 144, from about amino acid position 165 to about amino acid position 168, from about amino acid position 364 to about amino acid position 367, from about amino acid position 476 to about amino acid position 479, from about amino acid position 496 to about amino acid position 499, from about amino acid position 572 to about amino acid position 575, from about amino acid position 603 to about amino acid position 606 and from about amino acid position 699 to about amino acid position 702. Clone DNA66659-1593 has been deposited with ATCC on Sep. 22, 1998 and is assigned ATCC deposit no. 203269.

An analysis of the Dayhoff database (version 35.45 SwissProt 35), using a WU-BLAST2 sequence alignment analysis of the full-length sequence shown in FIG. 130 (SEQ ID NO:227), evidenced significant homology between the PRO1325 amino acid sequence and the following Dayhoff sequences: CELR04E5_1, CELZK721_5, CELC30E1_5, CELC30E1_6, CELC30E1_2, CEY37H2C_1, CELC30E117, CELT07H8_7 and E64006.

Example 69

Isolation of cDNA Clones Encoding Human PRO1340

Using the method set forth in Example 1 above, Incyte EST no. 878906 was identified as a sequence of interest having a BLAST score of 70 or greater that does not encode a known protein. The nucleotide sequence of EST no. 878906 is designated herein "DNA42809". Based on the DNA42809 sequence, oligonucleotides were synthesized: 1) to identify by PCR a cDNA library that contained the sequence of interest, and 2) for use as probes to isolate a clone of the full-length coding sequence for PRO1340.

PCR primers (forward and reverse) were synthesized:
forward PCR primer TCCAGGTGGACCCCACTTCAGG (42809. f1; SEQ ID NO:270)
reverse PCR primer GGGAGGCTTATAGGCCCAATCTGG (42809. r1; SEQ ID NO:271)

Additionally, a synthetic oligonucleotide hybridization probe was constructed from the DNA42809 sequence which had the following nucleotide sequence:
hybridization probe GGCTTCAGCAGCACGTGTGAAGTCGAAGTCGCAGTCACAGATATCAATGA (42809.p1; SEQ ID NO:272)

In order to screen several libraries for a source of a full-length clone, DNA from the libraries was screened by PCR amplification with the PCR primer pair identified above. A positive library was then used to isolate clones encoding the PRO1340 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1340 (designated herein as DNA66663-1598 [FIG. 131, SEQ ID NO:228]; and the derived protein sequence for PRO1340.

The entire coding sequence of PRO1340 is shown in FIG. 131 (SEQ ID NO:228). Clone DNA66663-1598 contains a single open reading frame with an apparent translational initiation site at nucleotide positions 128–130 and an apparent stop codon at nucleotide positions 2549–2551. The predicted polypeptide precursor is 807 amino acids long. The full-length PRO1340 protein shown in FIG. 132 has an estimated molecular weight of about 87,614 daltons and a pI of about 4.83. Additional features include: a signal peptide at about amino acids 1–18; a transmembrane domain at about amino acids 762–784; a cell attachment sequence at about amino acids 492–494; potential N-glycosylation sites at about amino acids 517–520, 602–605 and 700–703; and cadherin extracellular repeat domains at about amino acids 307–351, 324–348, 67–103, 97–141 and 114–138.

An analysis of the Dayhoff database (version 35.45 SwissProt 35), using a WU-BLAST2 sequence alignment analysis of the full-length sequence shown in FIG. 132 (SEQ ID NO:229), revealed significant homology between the PRO1340 amino acid sequence and Dayhoff sequence no. 146536. Homology was also revealed between the PRO1340 amino acid sequence and the following Dayhoff sequences: S55396, RATPDRPT_1, CADD_CHICK, CAD1_CHICK, CADB_CHICK, I50180, CAD4_CHICK, G02878, and DSC1_MOUSE.

Clone DNA66663-1598 has been deposited with ATCC and is assigned ATCC deposit no. 203268.

Example 70

Isolation of cDNA Clones Encoding Human PRO1339

A consensus DNA sequence was assembled relative to other EST sequences using phrap as described in Example 1 above. This consensus sequence is designated herein "DNA40652". Within the consensus sequence assembly was Incyte EST 2479394. Based on the consensus sequence and other discoveries and information provided herein, the clone including Incyte EST 2479394 was purchased and sequenced in full. Sequencing provided the nucleic acid sequence shown in FIG. 133 which includes the sequence encoding PRO1339.

Clone DNA66669-1597 contains a single open reading frame with an apparent translational initiation site at nucleotide positions 9–11 and an apparent stop codon at nucleotide positions 1272–1274 of SEQ ID NO:233. The predicted polypeptide precursor is 421 amino acids long. The signal peptide is at about amino acids 1–16 of SEQ ID NO:234. The region conserved in zinc carboxypeptidases and the N-glycosylation site are indcated in FIG. 134. Clone DNA66669-1597 has been deposited with the ATCC and is assigned ATCC deposit no. 203272. The full-length PRO1339 protein shown in FIG. 134 has an estimated molecular weight of about 47,351 daltons and a pI of about 6.61.

An analysis of the Dayhoff database (version 35.45 SwissProt 35), using a WU-BLAST2 sequence alignment analysis of the full-length sequence shown in FIG. 134 (SEQ ID NO:234), revealed sequence identity between the PRO1339 amino acid sequence and the following Dayhoff sequences (data incorporated herein): P_W01505, CBP1_HUMAN, HSA224866_1, P_R90293, YHT2_YEAST, CEF02D8_4, CEW01A8_6, P_W36815, HSU83411_1 and CBPN_HUMAN.

Example 71

Isolation of cDNA Clones Encoding Human PRO1337

Using the method described in Example 1 above, a single Incyte EST was identified (EST No.1747546) and also referred to herein as "DNA4417". To assemble a consensus sequence, repeated cycles of BLAST and phrap were used to extend the DNA4417 sequence as far as possible using the sources of EST sequences discussed above. The consensus sequence is designated herein as "DNA45669". Based on the DNA45669 consensus sequence, oligonucleotides were synthesized: 1) to identify by PCR a cDNA library that contained the sequence of interest, and 2) for use as probes to isolate a clone of the full-length coding sequence for PRO1337.

PCR primers (forward and reverse) were synthesized:
forward PCR primers: CAACCATGCAAGGA-CAGGGCAGG (45669. f1; SEQ ID NO:237) and CTTTGCTGTTGGCCTCTGTGCTCCCAAC-CATGCAAGGACAGGGCAGG (45669. r1; SEQ ID NO:238);
reverse PCR primers: TGACTCGGGGTCTCCAAAAC-CAGC (45669. r1; SEQ ID NO:239) and GGTATAGGCG-GAAGGCAAAGTCGG (45669. r2; SEQ ID NO:240);

Additionally, a synthetic oligonucleotide hybridization probe was constructed from the consensus DNA45669 sequence which had the following nucleotide sequence:
hybridization probe: GGCATCTTACCTTTATGGAG-TACTCTTTGCTGTTGGCCTCTGTGCTCC (45669.p1; SEQ ID NO:241).

In order to screen several libraries for a source of a full-length clone, DNA from the libraries was screened by PCR amplification with the PCR primer pair identified above. A positive library was then used to isolate clones encoding the PRO1337 gene using the probe oligonucleotide and one of the PCR primers. RNA for construction of the cDNA libraries was isolated from human tissue.

DNA sequencing of the clones isolated as described above gave the full-length DNA sequence for PRO1337 (designated herein as DNA66672-1586 [FIG. 135, SEQ ID NO:235]; and the derived protein sequence for PRO1337.

The entire coding sequence of PRO1337 is shown in FIG. 135 (SEQ ID NO:235). Clone DNA66672-1586 contains a single open reading frame with an apparent translational initiation site at nucleotide positions 60–62 and an apparent stop codon at nucleotide positions 1311–1313. The predicted polypeptide precursor is 417 amino acids long. The full-length PRO1337 protein shown in FIG. 136 has an estimated molecular weight of about 46,493 daltons and a pI of about 9.79.

An analysis of the Dayhoff database (version 35.45 SwissProt 35), using a WU-BLAST2 sequence alignment analysis of the full-length sequence shown in FIG. 136 (SEQ ID NO:236) revealed significant homology between the PRO1337 amino acid sequence and the Dayhoff sequence THBG_HUMAN. Homology was also found between the PRO1337 amino acid sequence and the following Dayhoff sequences: KAIN_HUMAN, HSACT1_1, IPSP_HUMAN, G02081, HAMHPP_1, CPI6_RAT, S31507, AB000547_1, and KBP_MOUSE.

Clone DNA66672-1586 was deposited with the ATCC on Sep. 22, 1998, and is assigned ATCC deposit no. 203265.

Example 72

Isolation of cDNA Clones Encoding Human PRO1342

A cDNA sequence isolated in the amylase screen described in Example 2 above is herein designated DNA43203. The DNA43203 sequence was then compared to a variety of expressed sequence tag (EST) databases which included public EST databases (e.g., GenBank) and proprietary EST DNA databases (LIFESEQ®, Incyte Pharmaceuticals, Palo Alto, Calif.; Genentech, South San Francisco, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is designated herein as "DNA48360".

Based on the DNA48360 sequence, oligonucleotide probes were generated and used to screen a human esophageal tissue library prepared as described in paragraph 1 of Example 2 above. The cloning vector was pRK5B (pRK5B is a precursor of pRK5D that does not contain the SfiI site; see, Holmes et al., *Science,* 253:1278–1280 (1991)), and the cDNA size cut was less than 2800 bp.

PCR primers (forward and reverse) were synthesized:
forward PCR primer: 5'-GAAGCACCAGCCTTTATCTCTTCACC-3' (48360. f1; SEQ ID NO:244)
reverse PCR primer: 5'-GTCAGAGTTGGTGGCTGTGCTAGC-3' (48360. r1; SEQ ID NO:245)
Additionally, a synthetic oligonucleotide hybridization probe was constructed from the DNA48360 sequence which had the following nucleotide sequence:
hybridization probe: 5'GGACCCAGGCATCTTGC TTTCCAGCCACAAAGAGACAGATGAAGATGC-3 (48360.p1; SEQ ID NO:246)

In order to screen several libraries for a source of a full-length clone, DNA from the libraries was screened by PCR amplification with the PCR primer pair identified above. A positive library was then used to isolate clones encoding the PRO1342 gene using the probe oligonucleotide and one of the PCR primers.

A full length clone was identified that contained a single open reading frame with an apparent translational initiation site at nucleotide positions 239–241, and a stop signal at nucleotide positions 2027–2029 (FIG. 137; SEQ ID NO:242). The predicted polypeptide precursor is 596 amino acids long has a calculated molecular weight of approximately 57,173 daltons and an estimated pI of approximately 4.82. Additional features include: signal sequence at about amino acids 1–20; a transmembrane domain at about amino acids 510–532; a potential N-glycosylation site at about amino acids 25–28; a glycosaminoglycan attachment site at about amino acids 325–328; and bacterial ice-nucleation protein octamer repeats at about amino acids 284–337, 404–457, 254–307, 359–412, 194–247, 239–292, 299–352, 134–187, 314–367, and 164–217.

An analysis of the Dayhoff database (version 35.45 SwissProt 35), using a WU-BLAST2 sequence alignment analysis of the full-length sequence shown in FIG. 138 (SEQ ID NO:243), evidenced some homology between the PRO1342 amino acid sequence and the following Dayhoff sequences: CELZC178_2, LMSAP2GN_1, D88734_, AMYH_YEAST, MMDSPPG_1, VGLX_HSVEB, S52714, CELF59A6_5, CELK06A9_3, and YM96_YEAST.

Clone DNA66674-1599 was deposited with the ATCC on Sep. 22, 1998, and is assigned ATCC deposit no. 203281.

Example 73

Isolation of cDNA Clones Encoding Human PRO1343

A cDNA sequence isolated in the amylase screen described in Example 2 above was found, by the WU-BLAST2 sequence alignment computer program, to have no significant sequence identity to any known human encoding nucleic acid. This cDNA sequence is herein designated DNA48921. Probes were generated from the sequence of the DNA48921 molecule and used to screen a human smooth muscle cell tissue library prepared as described in paragraph 1 above. The cloning vector was pRK5B (pRK5B is a precursor of pRK5D that does not contain the SfiI site; see, Holmes et al., *Science,* 253:1278–1280 (1991)), and the cDNA size cut was less than 2800 bp.

The oligonucleotide probes employed were as follows:
forward PCR primer (48921. f1) 5'-CAATATGCATCTTGCACGTCTGG-3' (SEQ ID NO:249)
reverse PCR primer (48921. r1) 5'-AAGCTTCTCTGCTTCCTTTCCTGC-3' (SEQ ID NO:250)
hybridization probe (48921. p1) 5'-TGACCCCATTG AGAAGGTCATTGAAGGGATCAACCGAGGGCTG-3' (SEQ ID NO:251)

A full length clone was identified that contained a single open reading frame with an apparent translational initiation site at nucleotide positions 71–73 and a stop signal at nucleotide positions 812–814 (FIG. 139, SEQ ID NO:247). The predicted polypeptide precursor is 247 amino acids long, has a calculated molecular weight of approximately 25,335 daltons and an estimated pI of approximately 7.0. Analysis of the full-length PRO1343 sequence shown in FIG. 140 (SEQ ID NO:248) evidences the presence of the following: a signal peptide from about amino acid 1 to about amino acid 25 and a homologous region to circumsporozoite repeats from about amino acid 35 to about amino acid 225. Clone DNA66675-1587 has been deposited with ATCC on Sep. 22, 1998 and is assigned ATCC deposit no. 203282.

An analysis of the Dayhoff database (version 35.45 SwissProt 35), using a WU-BLAST2 sequence alignment analysis of the full-length sequence shown in FIG. 140 (SEQ ID NO:248), evidenced significant homology between the PRO1343 amino acid sequence and the following Dayhoff sequences: CSP_PLACC, CEF25H8_2, U88974_40, BNAMRNAA_1, BOBOPC3_1, S58135, AF061832_1, BHU52040_1, HUMPROFILE_1 and MTV023_14.

Additionally, an Incyte EST clone (Incyte EST clone NO:4701148) having homology to the DNA48921 sequence was obtained and the insert sequenced, thereby giving rise to the DNA66675-1587 sequence shown in FIG. 139.

Example 74

Isolation of cDNA Clones Encoding Human PRO1480

Using the methods described in Example 1 above, Incyte EST Nos. 550415 and 1628847 were identified as sequences of interest having BLAST scores of 70 or greater that did not encode known proteins. These sequences were clustered and assembled into a consensus DNA sequence with the program "phrap" (Phil Green, University of Washington, Seattle, Wash.). This consensus sequence is designated herein as "DNA1395". In addition, the "DNA1395" consensus sequence was extended using repeated cycles of BLAST and phrap to extend the consensus sequence as far as possible using the sources of EST sequences discussed above. The extended consensus sequence is designated herein as "DNA40642". Based on the DNA40642 consensus sequence, oligonucleotides were synthesized: 1) to identify by PCR a cDNA library that contained the sequence of interest, and 2) for use as probes to isolate a clone of the full-length coding sequence for PRO1480.

PCR primers (forward and reverse) were synthesized: forward PCR primer: AGCCCGTGCAGAATCTGCTC-CTGG (40642. f1; SEQ ID NO:254)
reverse PCR primers: TGAAGCCAGGGCAGCGTC-CTCTGG (40642. r1; SEQ ID NO:255); GTACAGGCTG-CAGTTGGC (40642. r2; SEQ ID NO:256)

Additionally, synthetic oligonucleotide hybridization probes were constructed from the consensus DNA40642 sequence which had the following nucleotide sequence: hybridization probes: AGAAGCCATGTGAGCAAGTC-CAGTTCCAGCCCAACACAGTG (40642. p1; SEQ ID NO:257); GAGCTGCAGATCTTCTCATCGGGACAGC-CCGTGCAGAATCTGCTC (40642. p2; SEQ ID NO:258).

In order to screen several libraries for a source of a full-length clone, DNA from the libraries was screened by PCR amplification with the PCR primer pair identified above. A positive library was then used to isolate clones encoding the PRO1480 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1480, designated herein as DNA67962-1649 [FIG. 141, SEQ ID NO:252]; and the derived protein sequence for PRO1480.

The entire coding sequence of PRO1480 is shown in FIG. 141 (SEQ ID NO:252). Clone DNA67962-1649 contains a single open reading frame with an apparent translational initiation site at nucleotide positions 241–243 and an apparent stop codon at nucleotide positions 2752–2754. The predicted polypeptide precursor is 837 amino acids long. The full-length PRO1480 protein shown in FIG. 142 has an estimated molecular weight of about 92,750 daltons and a pI of about 7.04. Additional features include: transmembrane domains at about amino acids 23–46 (type II) and 718–738; potential N-glycosylation sites at about amino acids 69–72, 96–99, 165–168, 410–413, 525–528, and 630–633; and a leucine zipper pattern at about amino acids 12–33.

An analysis of the Dayhoff database (version 35.45 SwissProt 35), using a WU-BLAST2 sequence alignment analysis of the full-length sequence shown in FIG. 142 (SEQ ID NO:253), revealed significant homology between the PRO1480 amino acid sequence and Dayhoff sequence I48746. Homology was also shown between the PRO1480 amino acid sequence and the following Dayhoff sequences: S66498; P_W17658; MMU69535_1; HSU60800_1;I48745; A49069; I48747; GGU28240_1; and AF022946_1.

Clone DNA67962-1649 has been deposited with ATCC and is assigned ATCC deposit no. 203291.

Example 75

Isolation of cDNA Clones Encoding Human PRO1487

A single Merck EST, HSC2ID011, referred herein as "DNA8208", was identified as an EST of interest having a BLAST score of 70 or greater that did not encode a known protein as described in Example 1 above. The DNA8208 sequence was extended using repeated cycles of BLAST and the program "phrap" (Phil Green, University of Washington, Seattle, Wash.) to extend the sequence as far as possible using the sources of EST sequences discussed above. The resulting consensus sequence is designated herein as "DNA68836". Based on the DNA68836 consensus sequence, oligonucleotides were synthesized: 1) to identify by PCR a cDNA library that contained the sequence of interest, and 2) for use as probes to isolate a clone of the full-length coding sequence for PRO1487.

PCR primers (forward and reverse) were synthesized: forward PCR primer: GTGCCACTACGGGGTGTGGAC-GAC (54209. f1; SEQ ID NO:261) and
reverse PCR primer TCCCATTTCTTCCGTGGTGCCCAG (54209. r1; SEQ ID NO:262)

Additionally, a synthetic oligonucleotide hybridization probe was constructed from the consensus DNA68836 sequence which had the following nucleotide sequence: hybridization probe CCAGAAGAAGTCCTTCATGAT-GCTCAAGTACATGCACGACCACTAC (54209.p1; SEQ ID NO:263)

In order to screen several libraries for a source of a full-length clone, DNA from the libraries was screened by PCR amplification with the PCR primer pair identified above. A positive library was then used to isolate clones encoding the PRO1487 gene using the probe oligonucleotide and one of the PCR primers. RNA for construction of the cDNA libraries was isolated human fetal kidney tissue.

DNA sequencing of the clones isolated as described above gave the full-length DNA sequence for PRO1487 (designated herein as DNA68836-1656 (FIGS. 143A–B; SEQ ID NO:259) and the derived protein sequence for PRO1487 (FIG. 144; SEQ ID NO:260).

The entire coding sequence of PRO1487 is shown in FIGS. 143A–B (SEQ ID NO:259). Clone DNA68836-1656 contains a single open reading frame with an apparent translational initiation site at nucleotide positions 489–491 and an apparent stop codon at nucleotide positions 2895–2897. The predicted polypeptide precursor is 802 amino acids long The full-length PRO1487 protein shown in FIG. 144 has an estimated molecular weight of about 91,812 daltons and a pI of about 9.52. Additional features include a signal peptide at about amino acids 1–23; potential N-glycosylation sites at about amino acids 189–192, 623–626, and 796–799; and a cell attachment sequence at about amino acids 62–64.

An analysis of the Dayhoff database (version 35.45 SwissProt 35), using a WU-BLAST2 sequence alignment analysis of the full-length sequence shown in FIG. 144 (SEQ ID NO:260), revealed significant homology between the PRO1487 amino acid sequence and the following Dayhoff sequences: CET24D1_1, S44860, CELC02H6_1, CEC38H2_3, CELC17A2_5, CET09E11_10, CEE03H4_3, CELT22B11_3, GGU82088_1, and CEF56H6_1.

Clone DNA68836-1656 was deposited with the ATCC on Nov. 3, 1998, and is assigned ATCC deposit no. 203455.

Example 76

Isolation of cDNA Clones Encoding Human PRO1418

Use of the signal sequence algorithm described in Example 3 above allowed identification of an EST cluster sequence from an Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a placenta tissue library. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA58845.

In light of the sequence homology between the DNA58845 sequence and an EST included in Incyte clone 1306026, that clone was purchased and the cDNA insert was obtained and sequenced. The sequence of this cDNA insert is shown in FIG. 145 and is herein designated as DNA68864-1629.

The full length clone shown in FIG. 145 contained a single open reading frame with an apparent translational initiation site at nucleotide positions 138–140 and ending at the stop codon found at nucleotide positions 1188–1190 (FIG. 145; SEQ ID NO:264). The predicted polypeptide precursor (FIG. 146, SEQ ID NO:265) is 350 amino acids long with a signal peptide at about amino acids 1–19 of SEQ ID NO:265. PRO1418 has a calculated molecular weight of approximately 39,003 daltons and an estimated pI of approximately 5.59. Clone DNA68864-1629 was deposited with the ATCC on Sep. 22, 1998 and is assigned ATCC deposit no. 203276.

An analysis of the Dayhoff database (version 35.45 SwissProt 35), using a WU-BLAST2 sequence alignment analysis of the full-length sequence shown in FIG. 146 (SEQ ID NO:265), revealed sequence identity between the PRO1418 amino acid sequence and the following Dayhoff sequences (data incorporated herein):

AGA1_HAEIN (immunoglobulin a1 protease precursor), P_W03740, CELT23E7_1, SSN6_YEAST, MMPININ_1, AB00993_1, P_R52601, S22624, A10377_1 and MUA1_XENLA.

Example 77

Isolation of cDNA Clones Encoding Human PRO1472

An Incyte sequence was identified and put in a computer to determine whether it had homology with other proteins in databases. The EST databases included public EST databases (e.g., GenBank), and the proprietary EST database (LIFESEQ®, Incyte Pharmaceuticals, Palo Alto, Calif.). The search was performed using the computer program BLAST or BLAST2 [Altschul et al., *Methods in Enzymology*, 266:460–480 (1996)] as a comparison of the ECD protein sequences to a 6 frame translation of the EST sequences. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.).

A consensus DNA sequence encoding PRO1472 was assembled relative to other EST sequences using phrap. This consensus sequence is designated herein "DNA62824". Based on the DNA62824 consensus sequence and other discoveries and information provided herein, the Incyte clone including EST 1579843 (from a duodenal tissue library) found in the assembly was purchased and sequenced in full.

Sequencing provided the entire coding sequence of PRO1472 as shown in FIG. 147 (SEQ ID NO:266). Clone DNA68866-1644 contains a single open reading frame with an apparent translational initiation site at nucleotide positions 134–136 and an apparent stop codon at nucleotide positions 1532–1534 of SEQ ID NO:266. The predicted polypeptide precursor is 466 amino acids long. As indicated in FIG. 148, the signal peptide is at about amino acid positions 1–17 and the transmembrane domains are at about positions 131–150 and 235–259 of SEQ ID NO:267. Clone DNA68866-1644 has been deposited with ATCC and is assigned ATCC deposit no. 203283. The full-length PRO1472 protein shown in FIG. 148 has an estimated molecular weight of about 52,279 daltons and a pI of about 6.16.

An analysis of the Dayhoff database (version 35.45 SwissProt 35), using a WU-BLAST2 sequence alignment analysis of the full-length sequence shown in FIG. 148 (SEQ ID NO:267), revealed sequence identity between the PRO1472 amino acid sequence and the following Dayhoff sequences (data incorporated herein): BUTY_HUMAN, HS45P21_1, HS45P21_3, HS45P21_5, HS45P21_4, HSU90142_1, HSU90546_1, AF033107_1, MMHC135G15_7 and HSB73_1.

Example 78

Isolation of cDNA Clones Encoding Human PRO1461

Use of the signal sequence algorithm described in Example 3 above allowed identification of an EST cluster sequence from the LIFESEQ® database, designated Incyte EST Cluster No. 159103, and also referred to herein as "DNA10747". The DNA10747 sequence was then compared to a variety of EST databases which included public EST databases (e.g., GenBank) and the LIFESEQ® database, to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). One or more of the ESTs used in the assembly was derived from a library constructed from pancreatic tumor tissue. The consensus sequence obtained therefrom is herein designated "DNA59553".

In light of the sequence homology between the DNA59553 sequence and an EST sequence contained within Incyte EST no. 2944541, the EST clone was purchased and the cDNA insert was obtained and sequenced. The sequence of this cDNA insert is shown in FIG. 149 and is herein designated as DNA68871-1638.

The full length clone shown in FIG. 149 contained a single open reading frame with an apparent translational initiation site at nucleotide positions 32–34 and ending at the stop codon found at nucleotide positions 1301–1303 (FIG. 149; SEQ ID NO:268). The predicted polypeptide precursor (FIG. 150, SEQ ID NO:269) is 423 amino acids long. PRO1461 has a calculated molecular weight of approximately 47,696 daltons and an estimated pI of approximately 8.96. Additional features include: a type II transmembrane domain at about amino acids 21–40; an ATP/GTP-binding site motif A (P-loop) at about amino acids 359–366; a trypsin family histidine active site at about amino acids 228–233; potential N-myristoylation sites at about amino acids 179–184, 213–218, 317–322, and 360–365; and potential N-glycosylation sites at about amino acids 75–78, 166–169 and 223–226.

An analysis of the Dayhoff database (version 35.45 SwissProt 35), using a WU-BLAST2 sequence alignment analysis of the full-length sequence shown in FIG. 150 (SEQ ID NO:269), revealed significant homology between the PRO1461 amino acid sequence Dayhoff sequence no. P_R89435. Homology was also found to exist between the PRO1461 amino acid sequence and the following additional Dayhoff sequences: AB002134_1, P_R89430, P_W22987, HEPS_MOUSE, ENTK_HUMAN, P_W22986, KAL_MOUSE, ACRO_PIG, p_R57283, and TRY7_ANOGA.

Clone DNA68871-68871 was deposited with the ATCC on Sep. 22, 1998, and is assigned ATCC deposit no.203280.

Example 79

Isolation of cDNA clones Encoding Human PRO1410

Use of the signal sequence algorithm described in Example 3 above allowed identification of an EST cluster sequence from the Incyte database, designated Incyte EST cluster sequence no. 98502. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56451.

In light of the sequence homology between the DNA56451 sequence and an EST sequence contained within the Incyte EST clone no. 1257046, the Incyte EST clone 125046 was purchased and the cDNA insert was obtained and sequenced. The sequence of this cDNA insert is shown in FIG. 151 and is herein designated as DNA68874-1622.

Clone DNA68874-1622 contains a single open reading frame with an apparent translational initiation site at nucleotide positions 152–154 and ending at the stop codon at nucleotide positions 866–868 (FIG. 151). The predicted polypeptide precursor is 238 amino acids long (FIG. 152). The full-length PRO1410 protein shown in FIG. 152 has an estimated molecular weight of about 25,262 daltons and a pI of about 6.44. Analysis of the full-length PRO1410 sequence shown in FIG. 152 (SEQ ID NO:271) evidences the presence of the following: a signal peptide from about amino acid 1 to about amino acid 20, a transmembrane domain from about amino acid 194 to about amino acid 220 and a potential N-glycosylation site from about amino acid 132 to about amino acid 135. Clone DNA68874-1622 has been deposited with ATCC on Sep. 22, 1998 and is assigned ATCC deposit no. 203277

An analysis of the Dayhoff database (version 35.45 SwissProt 35), using a WU-BLAST2 sequence alignment analysis of the full-length sequence shown in FIG. 152 (SEQ ID NO:271), evidenced significant homology between the PRO1410 amino acid sequence and the following Dayhoff sequences: I48652, P_R76466, HSMHC3W36A_2, EPB4_HUMAN, P_R14256, EPA8_MOUSE, P_R77285, P_W13569, AF000560_1, and ASF1_HELAN.

Example 80

Isolation of cDNA Clones Encoding Human PRO1568

A consensus DNA sequence was assembled relative to other EST sequences using phrap to form an assembly as described in Example 1 above. The consensus sequence is designated herein "DNA54208". Based on the DNA54208 consensus sequence, the assembly and other information and discoveries provided herein, a clone including an EST in the assembly was ordered and sequenced. The EST is Incyte 3089490. Sequencing in full gave the sequence shown in FIG. 153.

The entire coding sequence of PRO1568 is included in FIG. 153 (SEQ ID NO:272). Clone DNA68880-1676 contains a single open reading frame with an apparent translational initiation site at nucleotide positions 208–210 and an apparent stop codon at nucleotide positions 1123–1125 of SEQ ID NO:272. The predicted polypeptide precursor is 305 amino acids long. The signal peptide, transmembrane regions, N-myristoylation and amidation sites are also indicated in FIG. 154. Clone DNA68880-1676 has been deposited with the ATCC and is assigned ATCC deposit no. 203319. The full-length PRO1568 protein shown in FIG. 154 has an estimated molecular weight of about 35,383 daltons and a pI of about 5.99.

An analysis of the Dayhoff database (version 35.45 SwissProt 35), using a WU-BLAST2 sequence alignment analysis of the full-length sequence shown in FIG. 154 (SEQ ID NO:273), revealed sequence identity between the PRO1568 amino acid sequence and the following Dayhoff sequences (incorporated herein): AF089749_1, AF054841_1, NAG2_HUMAN, CD63_HUMAN, CD82_HUMAN, P_W05732, P_R86834, A15_HUMAN, P_W27333 and CD37_HUMAN.

Example 81

Isolation of cDNA Clones Encoding Human PRO1570

A consensus DNA sequence encoding PRO1570 was assembled relative to other EST sequences using phrap as described in Example 1 above to form an assembly. This consensus sequence is designated herein as "DNA65415". Based on the DNA65415 consensus sequence and other discoveries and information provided herein, the clone including Incyte EST 3232285 (from a uterine/colon cancer tissue library) was purchased and sequenced in full which gave SEQ ID NO:274.

The entire coding sequence of PRO1570 is included in FIG. 155 (SEQ ID NO:274). Clone DNA68885-1678 contains a single open reading frame with an apparent translational initiation site at nucleotide positions 210–212 and an apparent stop codon at nucleotide positions 1506–1508 of SEQ ID NO:274. The predicted polypeptide precursor is 432 amino acids long. FIG. 275 shows a number of motifs. Clone DNA68885-1678 has been deposited with the ATCC and is assigned ATCC deposit no. 203311. The full-length PRO1570 protein shown in FIG. 156 has an estimated molecular weight of about 47,644 daltons and a pI of about 5.18.

An analysis of the Dayhoff database (version 35.45 SwissProt 35), using a WU-BLAST2 sequence alignment analysis of the full-length sequence shown in FIG. 156 (SEQ ID NO:275), revealed sequence identity between the PRO1570 amino acid sequence and the following Dayhoff sequences (incorporated herein): P_W22986, TMS2_HUMAN, HEPS_HUMAN, P_R89435, AB002134_1, KAL_MOUSE, ACRO_HUMAN, GEN12917, AF045649_1, and P_W34285.

Example 82

Isolation of cDNA Clones Encoding Human PRO1317

A consensus DNA sequence was assembled relative to other EST sequences using phrap as described in Example 1 above. This consensus sequence is designated herein "Consen8865". In addition, the Consen8865 consensus sequence was extended using repeated cycles of BLAST and phrap to extend the consensus sequence as far as possible using the sources of EST sequences discussed above. The extended consensus sequence is designated herein as "DNA63334". Based on the DNA63334 consensus sequence, oligonucleotides were synthesized: 1) to identify by PCR a cDNA library that contained the sequence of interest, and 2) for use as probes to isolate a clone of the full-length coding sequence for PRO1317.

PCR primers (forward and reverse) were synthesized:
forward PCR primer: CTGCTGGTGAAATCTGGCGTG-GAG (63334. f1; SEQ ID NO:278); and
reverse PCR primer: GTCTGGTCCTGGCTGTCCAC-CCAG (63334. r1; SEQ ID NO:279).

Additionally, a synthetic oligonucleotide hybridization probe was constructed from the consensus DNA63334 sequence which had the following nucleotide sequence:
hybridization probe: CATCTTGTCATGTACCTGGGAAC-CACCACAGGGTCGCTCCACAAG (63334.p1; SEQ ID NO:280).

In order to screen several libraries for a source of a full-length clone, DNA from the libraries was screened by PCR amplification with the PCR primer pair identified above. A positive library was then used to isolate clones encoding the PRO1317 gene using the probe oligonucleotide and one of the PCR primers. RNA for construction of the cDNA libraries was isolated from human hippocampal tissue.

DNA sequencing of the clones isolated as described above gave the full-length DNA sequence for PRO1317 (designated herein as DNA71166-1685 [FIG. 157, SEQ ID NO:276]; and the derived protein sequence for PRO1317.

The entire coding sequence of PRO1317 is shown in FIG. 157 (SEQ ID NO:276). Clone DNA71166-1685 contains a single open reading frame with an apparent translational initiation site at nucleotide positions 105–107 and an apparent stop codon at nucleotide positions 2388–2390. The predicted polypeptide precursor is 761 amino acids long and has an estimated molecular weight of about 83,574 daltons and a pI of about 6.78.

An analysis of the Dayhoff database (version 35.45 SwissProt 35), using a WU-BLAST2 sequence alignment analysis of the full-length sequence shown in FIG. 158 (SEQ ID NO:277), revealed significant homology between the PRO1317 amino acid sequence and Dayhoff sequence no. I48745. Homology was also revealed between the PRO1317 amino acid sequence the following Dayhoff sequences: I48746, GEN13418, P_W58540, P_217657, MUSC1_1, P_471380, U73167_5, HSU33920_1, and GG828240_1.

Clone DNA71166-1685 was deposited with the ATCC on Oct. 20, 1998, and is assigned ATCC deposit no. 203355.

Example 83

Isolation of cDNA Clones Encoding Human PRO1780

The DNA63837.init sequence was obtained as described in Example 1 above and was extended using repeated cycles of BLAST and the program "phrap" (Phil Green, University of Washington, Seattle) to extend the consensus sequence as far as possible using the sources of EST sequences discussed above. The extended consensus sequence is designated herein as "DNA63837". Based on the DNA63837 consensus sequence, oligonucleotides were synthesized: 1) to identify by PCR a cDNA library that contained the sequence of interest, and 2) for use as probes to isolate a clone of the full-length coding sequence for PRO1780.

PCR primers (forward and reverse) were synthesized:
forward PCR primer: TGCCTTTGCTCACCTAC-CCCAAGG (63837. f1; SEQ ID NO:283)
reverse PCR primer: TCAGGCTGGTCTCCAAA-GAGAGGG (63837. r1; SEQ ID NO:284)

Additionally, a synthetic oligonucleotide hybridization probe was constructed from the consensus DNA63837 sequence which had the following nucleotide sequence:
hybridization probe: CCCAAAGATGTCCACCTGGCTG-CAAATGTGAAAATTGTGGACTGG (63837.p1; SEQ ID NO:285)

In order to screen several libraries for a source of a full-length clone, DNA from the libraries was screened by PCR amplification with the PCR primer pair identified above. A positive library was then used to isolate clones encoding the PRO1780 gene using the probe oligonucleotide and one of the PCR primers. RNA for construction of the cDNA libraries was isolated from a human fetal kidney.

DNA sequencing of the clones isolated as described above gave the full-length DNA sequence for PRO1780 (designated herein as DNA71169-1709 [FIG. 159, SEQ ID NO:281]; and the derived protein sequence for PRO1780.

The entire coding sequence of PRO1780 is shown in FIG. 159 (SEQ ID NO:281). Clone DNA71169-1709 contains a single open reading frame with an apparent translational initiation site at nucleotide positions 68–70 and an apparent stop codon at nucleotide positions 1637–1639. The predicted polypeptide precursor is 523 amino acids long. The full-length PRO1780 protein shown in FIG. 160 has an estimated molecular weight of about 59,581 daltons and a pI of about 8.68. Additional features include a signal peptide sequence at about amino acids 1–19; a transmembrane domain at about amino acids 483–504; tyrosine phosphorylation sites at about amino acids 68–74 and 425–433; N-myristoylation sites at about amino acids 16–21, 301–206, 370–375, and 494–499; and a leucine zipper pattern at about amino acids 493–514.

An analysis of the Dayhoff database (version 35.45 SwissProt 35), using a WU-BLAST2 sequence alignment analysis of the full-length sequence shown in FIG. 160 (SEQ ID NO:282), revealed significant homology between the PRO1780 amino acid sequence and the following Dayhoff sequences: UDA2_RABIT, CGT_HUMAN, UD11_HUMAN, P_R26153, UDB1_RAT, HSU59209_1, AB010872_1, UDB5_MOUSE, UDB8_HUMAN, and UD14_HUMAN.

Clone DNA71169-1709 was deposited with the ATCC on Nov. 17, 1998, and is assigned ATCC deposit no. 203467.

Example 84

Isolation of cDNA Clones Encoding Human PRO1486

A consensus DNA sequence was assembled relative to other EST sequences using phrap as described in Example 1 above. This consensus sequence is designated herein "DNA48897". Based on the DNA48897 consensus sequence, oligonucleotides were synthesized: 1) to identify by PCR a cDNA library that contained the sequence of interest, and 2) for use as probes to isolate a clone of the full-length coding sequence for PRO1486.

PCR primers (forward and reverse) were synthesized:
forward PCR primer 5'AGGCAGCCACCAGCTCTGTGC-TAC3' (SEQ ID NO:288); and
reverse PCR primer 5'CAGAGAGGGAAGATGAG-GAAGCCAGAG3' (SEQ ID NO:289).

Additionally, a synthetic oligonucleotide hybridization probe was constructed from the consensus DNA48897 sequence which had the following nucleotide sequence: hybridization probe 5'CTGTGCTACTGCCCTTGGACCC TGGGGACCGAGTGTCTCTGC3'(SEQ ID NO:290).

In order to screen several libraries for a source of a full-length clone, DNA from the libraries was screened by PCR amplification with the PCR primer pair identified above. A positive library was then used to isolate clones encoding the PRO1486 gene using the probe oligonucleotide and one of the PCR primers. RNA for construction of the cDNA libraries was isolated from a human adenocarcinoma cell line.

DNA sequencing of the clones isolated as described above gave the full-length DNA sequence for PRO1486 and the derived protein sequence for PRO1486.

The entire coding sequence of PRO1486 is included in FIG. 161 (SEQ ID NO:286). Clone DNA71180-1655 contains a single open reading frame with an apparent translational initiation site at nucleotide positions 472–474 and an apparent stop codon at nucleotide positions 1087–1089 of SEQ ID NO:286. The predicted polypeptide precursor is 205 amino acids long. The signal peptide is at about amino acids 1–32 of SEQ ID NO:287. Regions similar to those of C1q and an N-glycolationi site are located as indicated in FIG. 162. Clone DNA71180-1655 has been deposited with the ATCC and is assigned ATCC deposit no. 203403. The full-length PRO1486 protein shown in FIG. 162 has an estimated molecular weight of about 21,521 daltons and a pI of about 7.07.

An analysis of the Dayhoff database (version 35.45 SwissProt 35), using a WU-BLAST2 sequence alignment analysis of the full-length sequence shown in FIG. 162 (SEQ ID NO:287), revealed sequence identity between the PRO1486 amino acid sequence and the following Dayhoff sequences: CERB_HUMAN, CERL_RAT, GEN11893, P_R22263, CA18_HUMAN, C1QC_HUMAN, AF054891_1, A57131, HUMC1Qb2_1, ACR3_MOUSE.

Example 85

Isolation of cDNA Clones Encoding Human PRO1433

A consensus DNA sequence was assembled relative to other EST sequences using phrap as described in Example 1 above. This consensus sequence is herein designated DNA45230. Based on the DNA45230 consensus sequence, oligonucleotides were synthesized: 1) to identify by PCR a cDNA library that contained the sequence of interest, and 2) for use as probes to isolate a clone of the full-length coding sequence for PRO1433.

PCR primers (forward and reverse) were synthesized:
forward PCR primer (45230.f1) 5'-GCTGACCTGGTTCCCATCTACTCC-3' (SEQ ID NO:293)
reverse PCR primer (45230.r1) 5'-CCCACAGACACCCATGACACTTCC-3' (SEQ ID NO:294)
Additionally, a synthetic oligonucleotide hybridization probe was constructed from the consensus DNA45230 sequence which had the following nucleotide sequence hybridization probe (45230.p1) 5'-AAGAATGA ATTGTACAAAG CAGGTGATCTTCGAGGAGGGCTCC TGGGGCC-3' (SEQ ID NO:295)

In order to screen several libraries for a source of a full-length clone, DNA from the libraries was screened by PCR amplification with the PCR primer pair identified above. A positive library was then used to isolate clones encoding the PRO1433 gene using the probe oligonucleotide and one of the PCR primers. RNA for construction of the cDNA libraries was isolated from human adrenal gland tissue.

DNA sequencing of the clones isolated as described above gave the full-length DNA sequence for PRO1433 (designated herein as DNA71184-1634 [FIG. 163, SEQ ID NO:291]; and the derived protein sequence for PRO1433.

The entire nucleotide sequence of DNA71184-1634 is shown in FIG. 163 (SEQ ID NO:291). Clone DNA71184-1634 contains a single open reading frame with an apparent translational initiation site at nucleotide positions 185–187 and ending at the stop codon at nucleotide positions 1349–1351 (FIG. 163). The predicted polypeptide precursor is 388 amino acids long (FIG. 164). The full-length PRO1433 protein shown in FIG. 164 has an estimated molecular weight of about 43,831 daltons and a pI of about 9.64. Analysis of the full-length PRO1433 sequence shown in FIG. 164 (SEQ ID NO:292) evidences the presence of the following: a transmembrane domain from about amino acid 76 to about amino acid 97, potential N-glycosylation sites from about amino acid 60 to about amino acid 63, from about amino acid 173 to about amino acid 176 and from about amino acid 228 to about amino acid 231 and potential N-myristolation sites from about amino acid 10 to about amino acid 15, from about amino acid 41 to about amino acid 46, from about amino acid 84 to about amino acid 89, from about amino acid 120 to about amino acid 125, from about amino acid 169 to about amino acid 174, from about amino acid 229 to about amino acid 234, from about amino acid 240 to about amino acid 245, from about amino acid 318 to about amino acid 323 and from about amino acid 378 to about amino acid 383. Clone DNA71184-1634 has been deposited with ATCC on Sep. 22, 1998 and is assigned ATCC deposit no. 203266.

An analysis of the Dayhoff database (version 35.45 SwissProt 35), using a WU-BLAST2 sequence alignment analysis of the full-length sequence shown in FIG. 164 (SEQ ID NO:292), evidenced significant homology between the PRO1433 amino acid sequence and the following Dayhoff sequences: CELW01A11_4, CEF59A1_4, S67138, MTV050_3, S75135 and S12411.

Example 86

Isolation of cDNA Clones Encoding Human PRO1490

A consensus DNA sequence was assembled relative to other EST sequences using phrap as described in Example 1 above. This consensus sequence is herein designated DNA67006. Based on the DNA67006 consensus sequence, oligonucleotides were synthesized: 1) to identify by PCR a cDNA library that contained the sequence of interest, and 2) for use as probes to isolate a clone of the full-length coding sequence for PRO1490.

PCR primers (forward and reverse) were synthesized:
forward PCR primer (67006.f1) 5'-CTTCCTCTGTGGGTGGACCATGTG-3' (SEQ ID NO:298)
reverse PCR primer (67006.r1) 5'-GCCACCTCCATGCTAACGCGG-3' (SEQ ID NO:299)
Additionally, a synthetic oligonucleotide hybridization probe was constructed from the consensus DNA67006 sequence which had the following nucleotide sequence hybridization probe (67006.p1) 5'-CCA AGGTCCTCGCTAAGAAGGAGCTGCTCTACGTGCC CCTCATCG-3' (SEQ ID NO:300)

In order to screen several libraries for a source of a full-length clone, DNA from the libraries was screened by PCR amplification with the PCR primer pair identified above. A positive library was then used to isolate clones encoding the PRO1490 gene using the probe oligonucleotide and one of the PCR primers. RNA for construction of the cDNA libraries was isolated from human adrenal gland tissue.

DNA sequencing of the clones isolated as described above gave the full-length DNA sequence for PRO1490 (designated herein as DNA71213-1659 [FIG. 165, SEQ ID NO:296]; and the derived protein sequence for PRO1490.

The entire nucleotide sequence of DNA71213-1659 is shown in FIG. 165 (SEQ ID NO:296). Clone DNA71213-1659 contains a single open reading frame with an apparent translational initiation site at nucleotide positions 272–274 and ending at the stop codon at nucleotide positions 1376–1378 (FIG. 165). The predicted polypeptide precursor is 368 amino acids long (FIG. 166). The full-length PRO1490 protein shown in FIG. 166 has an estimated molecular weight of about 42,550 daltons and a pI of about 9.11. Analysis of the full-length PRO1490 sequence shown in FIG. 166 (SEQ ID NO:297) evidences the presence of the following: a signal peptide from about amino acid 1 to about amino acid 25, transmembrane domains from about amino acid 307 to about amino acid 323 and from about amino acid 335 to about amino acid 352 and tyrosine kinase phosphorylation sites from about amino acid 160 to about amino acid 168 and from about amino acid 161 to about amino acid 168. Clone DNA71213-1659 has been deposited with ATCC on Oct. 27, 1998 and is assigned ATCC deposit no. 203401.

An analysis of the Dayhoff database (version 35.45 SwissProt 35), using a WU-BLAST2 sequence alignment analysis of the full-length sequence shown in FIG. 166 (SEQ ID NO:297), evidenced significant homology between the PRO1490 amino acid sequence and the following Dayhoff sequences: A52744_1, S60478, P_R99249, P_R59712, YBP2_YEAST, S54641, CELT05H4_15, CELF28B3_1, CELZK40_1 and YIHG_ECOLI.

Example 87

Isolation of cDNA Clones Encoding Human PRO1482

A cDNA clone (DNA71234-1651) encoding a native human PRO1482 polypeptide was identified by a yeast screen, in a human adrenal gland cDNA library that preferentially represents the 5' ends of the primary cDNA clones.

The full-length DNA71234-1651 clone shown in FIG. 167 contains a single open reading frame with an apparent translational initiation site at nucleotide positions 33–35 and ending at the stop codon at nucleotide positions 462–464 (FIG. 167). The predicted polypeptide precursor is 143 amino acids long (FIG. 168). The full-length PRO1482 protein shown in FIG. 168 has an estimated molecular weight of about 15,624 daltons and a pI of about 9.58. Analysis of the full-length PRO1482 sequence shown in FIG. 168 (SEQ ID NO:302) evidences the presence of the following: a signal peptide from about amino acid 1 to about amino acid 28. Clone DNA71234-1651 has been deposited with ATCC on Oct. 27, 1998 and is assigned ATCC deposit no. 203402.

An analysis of the Dayhoff database (version 35.45 SwissProt 35), using a WU-BLAST2 sequence alignment analysis of the full-length sequence shown in FIG. 168 (SEQ ID NO:302), evidenced significant homology between the PRO1482 amino acid sequence and the following Dayhoff sequences: A18267_3.

Example 88

Isolation of cDNA Clones Encoding Human PRO1446

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a pancreatic islet cell library. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56514.

In light of the sequence homology between the DNA56514 sequence and an EST sequence contained within the Incyte EST 2380344, the clone including this EST was purchased and the cDNA insert was obtained and sequenced. The sequence of this cDNA insert is shown in FIG. 169 and is herein designated as DNA71277-1636.

The full length clone shown in FIG. 169 contained a single open reading frame with an apparent translational initiation site at nucleotide positions 152–154 and ending at the stop codon found at nucleotide positions 479–481 (FIG. 169; SEQ ID NO:303). The predicted polypeptide precursor (FIG. 170, SEQ ID NO:304) is 109 amino acids long with a signal peptide at about amino acids 1–15 of SEQ ID NO:304. PRO1446 has a calculated molecular weight of approximately 11,822 daltons and an estimated pI of approximately 8.63. Clone DNA71277-1636 was deposited with the ATCC on Sep. 22, 1998 and is assigned ATCC deposit no. 203285.

An analysis of the Dayhoff database (version 35.45 SwissProt 35), using a WU-BLAST2 sequence alignment analysis of the full-length sequence shown in FIG. 170 (SEQ ID NO:304), revealed sequence identity between the PRO1446 amino acid sequence and the following Dayhoff sequences (data incorporated herein): P53_CANFA, P53_FELCA, LRP1_HSV1F, OSU57338_1, S75842, P_P93722, AF002189_1, B70408, S54309 and S53365. The first in this list is further described in Kraegel, et al., *Cancer Lett.*, 92(2):181–186 (1995).

Example 89

Isolation of cDNA Clones Encoding Human PRO1558

Use of the signal sequence algorithm described in Example 3 above allowed identification of an EST cluster sequence from the Incyte database, designated Incyte EST cluster sequence no. 86390. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480

(1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA58842.

In light of the sequence homology between the DNA58842 sequence and an EST sequence contained within the Incyte EST clone no. 3746964, the Incyte EST clone no. 3746964 was purchased and the cDNA insert was obtained and sequenced. The sequence of this cDNA insert is shown in FIG. 171 and is herein designated as DNA71282-1668.

Clone DNA71282-1668 contains a single open reading frame with an apparent translational initiation site at nucleotide positions 84–86 and ending at the stop codon at nucleotide positions 870–872 (FIG. 171). The predicted polypeptide precursor is 262 amino acids long (FIG. 172). The full-length PRO1558 protein shown in FIG. 172 has an estimated molecular weight of about 28,809 daltons and a pI of about 8.80. Analysis of the full-length PRO1558 sequence shown in FIG. 172 (SEQ ID NO:306) evidences the presence of the following: a signal peptide from about amino acid 1 to about amino acid 25, transmembrane domains from about amino acid 8 to about amino acid 30 and from about amino acid 109 to about amino acid 130, a potential N-glycosylation site from about amino acid 190 to about amino acid 193, a tyrosine kinase phosphorylation site from about amino acid 238 to about amino acid 246, potential N-myristolation sites from about amino acid 22 to about amino acid 27, from about amino acid 28 to about amino acid 33, from about amino acid 110 to about amino acid 115, from about amino acid 205 to about amino acid 210 and from about amino acid 255 to about amino acid 260 and amidation sites from about amino acid 31 to about amino acid 34 and from about amino acid 39 to about amino acid 42. Clone DNA71282-1668 has been deposited with ATCC on Oct. 6, 1998 and is assigned ATCC deposit no. 203312.

An analysis of the Dayhoff database (version 35.45 SwissProt 35), using a WU-BLAST2 sequence alignment analysis of the full-length sequence shown in FIG. 172 (SEQ ID NO:306), evidenced significant homology between the PRO1558 amino acid sequence and the following Dayhoff sequences: AF075724_2, MXU24657_3, CAMT_EUCGU, MSU20736_1, P_R29515, B70431, JC4004, CEY32B12A_3, CELF53B3_2 and P_R13543.

Example 90

Isolation of cDNA Clones Encoding Human PRO1604

An expressed sequence tag (EST) DNA database (LIFESEQ®, Incyte Pharmaceuticals, Palo Alto, Calif.) was searched. Incyte EST No. 3550440 was identified as having homology to HDGF. EST No. 3550440 was then compared to various EST databases including public EST databases (e.g. GenBank), and the LIFESEQ® database, to identify homologous EST sequences. The search was performed using the computer program BLAST or BLAST2 [Altschul et al., *Methods in Enzymology*, 266:460–480 (1996)]. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.). This consensus sequence is designated herein "DNA67237".

In light of the sequence homology between the DNA67237 sequence and EST no. 3367060 from tile LIFESEQ® database, the clone containing Incyte EST No. 3367060 was purchased and the cDNA insert was obtained and sequenced to obtain the entire coding sequence of PRO1604 which is shown in FIG. 173 (SEQ ID NO:307).

Clone DNA71286-1687 contains a single open reading frame with an apparent translational initiation site at nucleotide positions 65–67 and an apparent stop codon at nucleotide positions 2078–2080. The predicted polypeptide precursor is 671 amino acids long. The full-length PRO1604 protein shown in FIG. 174 has an estimated molecular weight of about 74,317 daltons and a pI of about 7.62. Additional features include a signal peptide at about amino acids 1–13; potential cAMP- and cGMP-dependent protein kinase phosphorylation sites at about amino acids 156–159, 171–174, and 451–454; potential N-myristoylation sites at about amino acids 46–51, 365–370, and 367–372; and a cell attachment sequence at about amino acids 661–663.

An analysis of the Dayhoff database (version 35.45 SwissProt 35), using a WU-BLAST2 sequence alignment analysis of the full-length sequence shown in FIG. 174 (SEQ ID NO:308), revealed significant homology between the PRO1604 amino acid sequence and Dayhoff sequence no. P_W37483. Homology was also shown between the PRO1604 amino acid sequence and the following additional Dayhoff sequences: AF063020_1, P_R66727, P_W37482, JC5661, CEC25A1_11, CEU33058_1, I38073, MST2_DROHY, and HSATRX36_1.

Clone DNA71286-1687 was deposited with the ATCC on Oct. 20, 1998, and is assigned ATCC deposit no. 203357.

Example 91

Isolation of cDNA Clones Encoding Human PRO1491

A consensus DNA sequence was assembled relative to other EST sequences using phrap as described in Example 1 above. This consensus sequence is herein designated DNA67202. Based on the DNA67202 consensus sequence, oligonucleotides were synthesized: 1) to identify by PCR a cDNA library that contained the sequence of interest, and 2) for use as probes to isolate a clone of the full-length coding sequence for PRO1491.

PCR primers (forward and reverse) were synthesized:
forward PCR primer (67202.f1)
5'-CAACGCAGCCGTGATAAACAAGTGG-3' (SEQ ID NO:311)
reverse PCR primer (67202.r1)
5'-GCTTGGACATGTACCAGGCCGTGG-3' (SEQ ID NO:312)
Additionally, a synthetic oligonucleotide hybridization probe was constructed from the consensus DNA67202 sequence which had the following nucleotide sequence hybridization probe (67202.p1) 5'-GGCCA GACT-GATTTGCTCAATTCCTGGAAGTGATGGGGCA GATAC-3' (SEQ ID NO:313)
RNA for construction of the cDNA libraries was isolated from human aortic endothelial cell tissue.

DNA sequencing of the clones isolated as described above gave the full-length DNA sequence for PRO1491 (designated herein as DNA71883-1660 [FIG. 175, SEQ ID NO:309]; and the derived protein sequence for PRO1491.

The entire nucleotide sequence of DNA71883-1660 is shown in FIG. 175 (SEQ ID NO:309). Clone DNA71883-1660 contains a single open reading frame with an apparent translational initiation site at nucleotide positions 107–109 and ending at the stop codon at nucleotide positions 2438–2440 (FIG. 175). The predicted polypeptide precursor is 777 amino acids long (FIG. 176). The full-length PRO1491 protein shown in FIG. 176 has an estimated molecular weight of about 89,651 daltons and a pI of about 7.97. Analysis of the full-length PRO1491 sequence shown in FIG. 176 (SEQ ID NO:310) evidences the presence of the following: a signal peptide from about amino acid 1 to about amino acid 36, potential N-glycosylation sites from about amino acid 139 to about amino acid 142, from about amino acid 607 to about amino acid 610 and from about amino acid 724 to about amino acid 727, a tyrosine kinase phosphorylation site from about amino acid 571 to about amino acid 576 and a gram-positive cocci surface protein anchoring hexapeptide sequence from about amino acid 32 to about amino acid 37. Clone DNA71883-1660 has been deposited with ATCC on Nov. 17, 1998 and is assigned ATCC deposit no. 203475.

An analysis of the Dayhoff database (version 35.45 SwissProt 35), using a WU-BLAST2 sequence alignment analysis of the full-length sequence shown in FIG. 176 (SEQ ID NO:310), evidenced significant homology between the PRO1491 amino acid sequence and the following Dayhoff sequences: GGU28240_1, MUSC1_1, D49423, MMSEMH_1, AB002329_1, AF022947_1, HSU33920_1, HUMLUCA19_1, G01856 and AF022946_1.

Example 92

Isolation of cDNA Clones Encoding Human PRO1431

An expressed sequence tag (EST) DNA database (LIFESEQ®, Incyte Pharmaceuticals, Palo Alto, Calif.) was searched and an EST (isolated from adult brain stem tissue) was identified (1370141, DNA66505) which showed homology to SH3. RNA for construction of cDNA libraries was isolated from human bone marrow. A full length cDNA corresponding to the isolated EST was isolated using an in vitro cloning technique (DNA73401-1633) in pRK5.

The cDNA libraries used to isolate the cDNA clones encoding human PRO1431 were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or PRKD; pRK5B is a precursor of pRK5D that does not contain the SfiI site; see, Holmes et al., *Science*, 253:1278–1280 (1991)) in the unique XhoI and NotI.

A cDNA clone was sequenced in entirety. The entire nucleotide sequence of DNA73401-1633 (SEQ ID NO:314) is shown in FIG. 177. Clone DNA73401-1633 contains a single open reading frame with an apparent translational initiation site at about nucleotide positions 630–632 and a stop codon at about nucleotide positions 1740–1742. The predicted polypeptide precursor encoded by DNA73401-1633 is 370 amino acids long. Clone DNA73401 (designated as DNA73402-1633) has been deposited with ATCC and is assigned ATCC deposit no. 203273.

Based sequence alignment analysis (using the ALIGN computer program) of the full-length sequence, PRO1431 shows significant amino acid sequence identity to SH17_HUMAN, an SH3 containing protein known as SH3P17. Additional significant identity score were found with D89164_1, AF032118_1, EXLP_TOBAC, YHR4_YEAST, S46992, RATP130CAS_2, AF043259_1, RATP130CAS_1 and MYSC_ACACA.

Example 93

Isolation of cDNA Clones Encoding Human PRO1563

A consensus DNA sequence was assembled relative to other EST sequences using phrap as described in Example 1 above. This consensus sequence is herein designated DNA67191. Based on the DNA67191 consensus sequence, oligonucleotides were synthesized: 1) to identify by PCR a cDNA library that contained the sequence of interest, and 2) for use as probes to isolate a clone of the full-length coding sequence for PRO1563.

PCR primers (forward and reverse) were synthesized:
forward PCR primer (67191.f1)
5'-CCCTGAAGCTGCCAGATGGCTCC-3' (SEQ ID NO:318)
reverse PCR primer (67191.r1)
5'-CTGTGCTCTTCGGTGCAGCCAGTC-3' (SEQ ID NO:319)
Additionally, a synthetic oligonucleotide hybridization probe was constructed from the consensus DNA67191 sequence which had the following nucleotide sequence
hybridization probe (67191.p1)
5'-CCACAGATGTGGTACTGCCTGGGGCAGTCAGC TTGCGCTACAG-3' (SEQ ID NO:320)

In order to screen several libraries for a source of a full-length clone, DNA from the libraries was screened by PCR amplification with the PCR primer pair identified above. A positive library was then used to isolate clones encoding the PRO1563 gene using the probe oligonucleotide and one of the PCR primers. RNA for construction of the cDNA libraries was isolated from human bone marrow tissue.

DNA sequencing of the clones isolated as described above gave the full-length DNA sequence for PRO1563 (designated herein as DNA73492-1671 [FIGS. 179A–B, SEQ ID NO:316]; and the derived protein sequence for PRO1563.

The entire nucleotide sequence of DNA73492-1671 is shown in FIGS. 179A–B (SEQ ID NO:316). Clone DNA73492-1671 contains a single open reading frame with an apparent translational initiation site at nucleotide positions 419–421 and ending at the stop codon at nucleotide positions 2930–2932 (FIGS. 179A–B). The predicted polypeptide precursor is 837 amino acids long (FIG. 180). The full-length PRO1563 protein shown in FIG. 180 has an estimated molecular weight of about 90,167 daltons and a pI of about 8.39. Analysis of the full-length PRO1563 sequence shown in FIG. 180 (SEQ ID NO:317) evidences the presence of the following: a signal peptide from about amino acid 1 to about amino acid 48, a potential N-glycosylation site from about amino acid 68 to about amino acid 71, glycosaminoglycan attachment sites from about amino acid 188 to about amino acid 191 and from about amino acid 772 to about amino acid 775, a cAMP- and cGMP-dependent protein kinase phosphorylation site from about amino acid 182 to about amino acid 185, a tyrosine kinase phosphorylation site from about amino acid 730 to about amino acid 736, potential N-myristolation sites from about amino acid 5 to about amino acid 10, from about amino acid 19 to about amino acid 24, from about amino acid 121 to about amino acid 126, from about amino acid 125 to about amino acid 130, from about amino acid 130 to about amino acid 135, from about amino acid 147 to about amino acid 152, from about amino acid 167 to about amino acid 172, from about amino acid 168 to about amino acid 173, from about amino acid 174 to about amino acid 179, from about amino acid 323 to about amino acid 328, from about amino acid 352 to about amino acid 357, from about amino acid 539 to about amino acid 544, from about amino acid 555 to about amino acid 560, from about amino acid 577 to about amino acid 582, from about amino acid 679 to about amino acid 684, from about amino acid 682 to about amino acid 687, and from about amino acid 763 to about amino acid 768, amidation sites from about amino acid 560 to about amino acid 563 and from about amino acid 834 to about amino acid 837, leucine zipper pattern sequences from about amino acid 17 to about amino acid 38 and from about amino acid 24 to about amino acid 45 and a neutral zinc metallopeptidase, zinc-binding region signature sequence from about amino acid 358 to about amino acid 367. Clone DNA73492-1671 has been deposited with ATCC on Oct. 6, 1998 and is assigned ATCC deposit no. 203324.

An analysis of the Dayhoff database (version 35.45 SwissProt 35), using a WU-BLAST2 sequence alignment analysis of the full-length sequence shown in FIG. 180 (SEQ ID NO:317), evidenced significant homology between the PRO1563 amino acid sequence and the following Dayhoff sequences: AB014588_1, D67076_1, AB001735_1, P_W47028, AB002364_1, P_W47029, GEN13695, P_R40823, AF005665_1 and DISA_TRIGA.

Example 94

Isolation of cDNA Clones Encoding Human PRO1565

A consensus DNA sequence was assembled relative to other EST sequences using phrap as described in Example 1 above. This consensus sequence is herein designated DNA67183. Based on an observed homology between the DNA67183 consensus sequence and an EST sequence contained within Incyte EST clone no. 2510320, Incyte EST clone no. 2510320 was purchased and its insert was obtained and sequenced. That insert sequence is shown in FIG. 181 and is herein designated DNA73727-1673 (SEQ ID NO:321).

The entire nucleotide sequence of DNA73727-1673 is shown in FIG. 181 (SEQ ID NO:321). Clone DNA73727-1673 contains a single open reading frame with an apparent translational initiation site at nucleotide positions 59–61 and ending at the stop codon at nucleotide positions 1010–1012 (FIG. 181). The predicted polypeptide precursor is 317 amino acids long (FIG. 182). The full-length PRO1565 protein shown in FIG. 182 has an estimated molecular weight of about 37,130 daltons and a pI of about 5.18. Analysis of the full-length PRO1565 sequence shown in FIG. 182 (SEQ ID NO:322) evidences the presence of the following: a signal peptide from about amino acid 1 to about amino acid 40, a potential type II transmembrane domain from about amino acid 25 to about amino acid 47, potential N-glycosylation sites from about amino acid 94 to about amino acid 97 and from about amino acid 180 to about amino acid 183, glycosaminoglycan attachment sites from about amino acid 92 to about amino acid 95, from about amino acid 70 to about amino acid 73, from about amino acid 85 to about amino acid 88, from about amino acid 133 to about amino acid 136, from about amino acid 148 to about amino acid 151, from about amino acid 192 to about amino acid 195 and from about amino acid 239 to about amino acid 242, potential N-myristolation sites from about amino acid 33 to about amino acid 38, from about amino acid 95 to about amino acid 100, from about amino acid 116 to about amino acid 121, from about amino acid 215 to about amino acid 220 and from about amino acid 272 to about amino acid 277, a microbodies C-terminal targeting signal sequence from about amino acid 315 to about amino acid 317 and a cytochrome C family heme-binding site signature sequence from about amino acid 9 to about amino acid 14. Clone DNA73727-1673 has been deposited with ATCC on Nov. 3, 1998 and is assigned ATCC deposit no. 203459.

An analysis of the Dayhoff database (version 35.45 SwissProt 35), using a WU-BLAST2 sequence alignment analysis of the full-length sequence shown in FIG. 182 (SEQ ID NO:322), evidenced significant homology between the PRO1565 amino acid sequence and the following Dayhoff sequences: AF051425_1, P_R65490, P_R65488, GRPE_STAAU, RNU31330_1, ACCD_BRANA, D50558_1, HUMAMYAB3_1, P_W34452 and P_P50629.

Example 95

Isolation of cDNA Clones Encoding Human PRO1571

A consensus DNA sequence was assembled relative to other EST sequences using phrap as described in Example 1 above. This consensus sequence is herein designated DNA69559. Based on homology observed between the DNA69559 consensus sequence and an EST sequence contained within the Incyte EST clone no. 3140760, Incyte EST clone no. 3140760 was purchased and the cDNA insert was obtained and sequenced. The sequence of this cDNA insert is shown in FIG. 183 and is herein designated as DNA73730-1679.

Clone DNA73730-1679 contains a single open reading frame with an apparent translational initiation site at nucleotide positions 90–92 and ending at the stop codon at nucleotide positions 807–809 (FIG. 183). The predicted polypeptide precursor is 239 amino acids long (FIG. 184). The full-length PRO1571 protein shown in FIG. 184 has an estimated molecular weight of about 25,699 daltons and a pI of about 8.99. Analysis of the full-length PRO1571 sequence shown in FIG. 184 (SEQ ID NO:324) evidences the presence of the following: a signal peptide from about amino acid 1 to about amino acid 21 and transmembrane domains from about amino acid 82 to about amino acid 103, from about amino acid 115 to about amino acid 141 and from about amino acid 160 to about amino acid 182. Clone DNA73730-1679 has been deposited with ATCC on Oct. 6, 1998 and is assigned ATCC deposit no. 203320.

An analysis of the Dayhoff database (version 35.45 SwissProt 35), using a WU-BLAST2 sequence alignment analysis of the full-length sequence shown in FIG. 184 (SEQ ID NO:324), evidenced significant homology between the PRO1571 amino acid sequence and the following Dayhoff sequences: AF072128_1, AB000712_1, AB000714_1, AF007189_1, AF000959_1, AF068863_1, P_W15288, PM22_HUMAN, P_R30056 and LSU46824_1.

Example 96

Isolation of cDNA Clones Encoding Human PRO1572

Using the method described in Example 1 above, a consensus sequence was obtained. The consensus sequence is designated herein "DNA69560". Based on the DNA69560 consensus sequence and other information provided herein, a clone including another EST (Incyte DNA3051424) from the assembly was purchased and sequenced.

The entire coding sequence of PRO1573 is included in FIG. 185 (SEQ ID NO:325). Clone DNA73734-1680 contains a single open reading frame with an apparent translational initiation site at nucleotide positions 90–92 and an apparent stop codon at nucleotide positions 873–875. The predicted polypeptide precursor is 261 amino acids long. The signal peptide is at about amino acids 1–23 and the transmembrane domains are at about amino acids 81–100, 121–141, and 173–194 of SEQ ID NO:326. One or more of the transmembrane domains can be deleted or inactivated. The locations of a N-glycosylation site, N-myristoylation sites, a tyrosine kinase phosphorylation site and a prokaryotic membrane lipoprotein lipid attachment site are indicated in FIG. 186. Clone DNA73734-1680 has been deposited with the ATCC and is assigned ATCC deposit no. 203363. The full-length PRO1572 protein shown in FIG. 186 has an estimated molecular weight of about 27,856 daltons and a pI of about 8.5.

An analysis of the Dayhoff database (version 35.45 SwissProt 35), using a WU-BLAST2 sequence alignment analysis of the full-length sequence shown in FIG. 186 (SEQ ID NO:326), revealed sequence identity between the PRO1572 amino acid sequence and the following Dayhoff sequences (incorporated herein): AF072127_1, HSU89916_1, AB000713_1, AB000714_1, AB000712_1, AF000959_1, AF072128_1, AF068863_1, P_W29881, and P_W58869.

Example 97

Isolation of cDNA Clones Encoding Human PRO1573

EST 3628990 was identified in an Incyte Database, (LIFESEQ®, Incyte Pharmaceuticals, Palo Alto, Calif.) and extended in a comparison to other sequences in databases to form an assembly. The alignment search was performed using the computer program BLAST or BLAST2 [Altschul et al., *Methods in Enzymology*, 266:460–480 (1996)] as a comparison of the ECD protein sequences to a 6 frame translation of the EST sequences. Those comparisons resulting in a BLAST score of 70 (or in some cases, 90) or greater that did not encode known proteins were clustered and assembled into consensus DNA sequences with the program "phrap" (Phil Green, University of Washington, Seattle, Wash.). The consensus sequence is designated herein "DNA69561".

Based on the DNA69561 consensus sequence and other information provided herein, a clone including another EST (Incyte DNA3752657) from the assembly was purchased and sequenced. This clone came from a breast tumor tissue library.

The entire coding sequence of PRO1573 is included in FIG. 187 (SEQ ID NO:327). Clone DNA73735-1681 contains a single open reading frame with an apparent translational initiation site at nucleotide positions 97–99 and an apparent stop codon at nucleotide positions 772–774. The predicted polypeptide precursor is 225 amino acids long. The signal peptide is at about amino acids 1–17 and the transmembrane domains are at about amino acids 82–101, 118–145, and 164–188 of SEQ ID NO:328. One or more of the transmembrane domains can be deleted or inactivated. A phosphorylation site, amidation site, and N-myristoylation sites are shown in FIG. 188. Clone DNA73735-1681 has been deposited with ATCC and is assigned ATCC deposit no. 203356. The full-length PRO1573 protein shown in FIG. 188 has an estimated molecular weight of about 24,845 daltons and a pI of about 9.07.

An analysis of the Dayhoff database (version 35.45 SwissProt 35), using a WU-BLAST2 sequence alignment analysis of the full-length sequence shown in FIG. 188 (SEQ ID NO:328), revealed sequence identity between the PRO1573 amino acid sequence and the following Dayhoff sequences (incorporated herein): AF007189_1, AB000714_1, AB000713_1, AB000712_1, A39484, AF000959_1, AF072127_, AF072128_1, AF068863_1 and AF077739_1.

Example 98

Isolation of cDNA Clones Encoding Human PRO1488

An expressed sequence tag (EST) DNA database (LIFESEQ®, Incyte Pharmaceuticals, Palo Alto, Calif.) was searched and EST No. 3639112H1 was identified as having homology to CPE-R. EST No. 3639112H1 is designated herein as "DNA69562". EST clone 3639112H1, which was derived from a lung tissue library of a 20-week old fetus who died from Patau's syndrome, was purchased and the cDNA insert was obtained and sequenced in its entirety. The entire nucleotide sequence of PRO1488 is shown in FIG. 189 (SEQ ID NO:329), and is designated herein as DNA73736-1657. DNA73736-1657 contains a single open reading frame with an apparent translational initiation site at nucleotide positions 6–8 and a stop codon at nucleotide positions 666–668 (FIG. 189; SEQ ID NO:329). The predicted polypeptide precursor is 220 amino acids long.

The full-length PRO1488 protein shown in FIG. 190 has an estimated molecular weight of about 23,292 daltons and a pI of about 8.43. Four transmembrane domains have been identified as being located at about amino acid positions 8–30, 82–102, 121–140, and 166–186.

An analysis of the Dayhoff database (version 35.45 SwissProt 35), using a WU-BLAST2 sequence alignment analysis of the full-length sequence shown in FIG. 190 (SEQ ID NO:330), revealed significant homology between the PRO1488 amino acid sequence and Dayhoff sequence AB000712_1. Homology was also found between the PRO1488 amino acid sequence and the following additional Dayhoff sequences: AB000714_1, AF007189_1, AF000959_1, P_W63697, MMU82758_1, AF072127_1, AF072128_1, HSU89916_1, AF068863_1, CEAF000418_1, and AF077739_1.

Clone DNA73736-1657 was deposited with the ATCC on Nov. 17, 1998, and is assigned ATCC deposit no. 203466.

Example 99

Isolation of cDNA Clones Encoding Human PRO1489

A consensus DNA sequence was assembled relative to other EST sequences using phrap as described in Example 1 above. This consensus sequence is herein designated DNA69563. Based upon an observed sequence similarity between the DNA69563 consensus sequence and an EST sequence contained within the Incyte EST clone no. 3376608, Incyte EST clone no. 3376608 was purchased and its insert obtained and sequenced. That insert is herein designated DNA73737-1658.

The entire nucleotide sequence of DNA73737-1658 is shown in FIG. 191 (SEQ ID NO:331). Clone DNA73737-1658 contains a single open reading frame with an apparent translational initiation site at nucleotide positions 264–266 and ending at the stop codon at nucleotide positions 783–785 (FIG. 191). The predicted polypeptide precursor is 173 amino acids long (FIG. 192). The full-length PRO1489 protein shown in FIG. 192 has an estimated molecular weight of about 18,938 daltons and a pI of about 9.99. Analysis of the full-length PRO1489 sequence shown in FIG. 192 (SEQ ID NO:332) evidences the presence of the following: transmembrane domains from about amino acid 31 to about amino acid 51, from about amino acid 71 to about amino acid 90 and from about amino acid 112 to about amino acid 133 and a potential N-glycosylation site from about amino acid 161 to about amino acid 164. Clone DNA73737-1658 has been deposited with ATCC on Oct. 27, 1998 and is assigned ATCC deposit no. 203412.

An analysis of the Dayhoff database (version 35.45 SwissProt 35), using a WU-BLAST2 sequence alignment analysis of the full-length sequence shown in FIG. 192 (SEQ ID NO:332), evidenced significant homology between the PRO1489 amino acid sequence and the following Dayhoff sequences: AF007189_1, AB000712_1, AF000959_1, MMU82758_1, AF035814_1, AF072127_1, AF072128_1, HSU89916_1, AF068863_1 and PPU50051_1.

Example 100

Isolation of cDNA Clones Encoding Human PRO1474

An expressed sequence tag (EST) DNA database (LIFESEQ®, Incyte Pharmaceuticals, Palo Alto, Calif.) was searched and an EST was identified. This EST showed homology to pancreatic secretory trypsin inhibitor.

The clone which included this EST was purchased from Incyte (it came from a uterine cervical tissue library) and sequenced in full to reveal the nucleic acid of SEQ ID NO:333, which encodes PRO1474.

The entire nucleotide sequence of PRO1474 is shown in FIG. 193 (SEQ ID NO:333). Clone DNA73739-1645 contains a single open reading frame with an apparent translational initiation site at nucleotide positions 45–47 and a stop codon at nucleotide positions 300–302 (FIG. 193; SEQ ID NO:333). The predicted polypeptide precursor is 85 amino acids long. As indicated in FIG. 194, the Kazal serine protease inhibitor family signature begins at about amino acid 45 of SEQ ID NO:334. Also indicated in FIG. 194 is a region conserved in integrin alpha chains (beginning at about amino acid 32 of SEQ ID NO:334). Clone DNA73739-1645 has been deposited with the ATCC and is assigned ATCC deposit no. 203270. The full-length PRO1474 protein shown in FIG. 194 has an estimated molecular weight of about 9,232 daltons and a pI of about 7.94.

An analysis of the Dayhoff database (version 35.45 SwissProt 35), using a WU-BLAST2 sequence alignment analysis of the full-length sequence shown in FIG. 194 (SEQ ID NO:334), revealed sequence identity between the PRO1474 amino acid sequence and the following Dayhoff sequences (all ovomucoids, data incorporated herein by reference): IOVO_FRAER, IOVO_FRAAF, IOVO_FRACO, IOVO_CYRMO, IOVO_STRCA, H61492, C61589, IOVO_POLPL, D61589, and IOVO_TURME.

Example 101

Isolation of cDNA Clones Encoding Human PRO1508

Use of the signal sequence algorithm described in Example 3 above allowed identification of an EST cluster sequence from the LIFESEQ® database, designated Incyte Cluster No. 34523, also referred herein as "DNA10047". This EST cluster sequence was then compared to a variety of expressed sequence tag (EST) databases which included public and private EST databases (e.g., GenBank and (LIFESEQ®) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated "DNA55723".

In light of the sequence homology between the DNA55723 sequence a sequence contained within Incyte EST no. 2989064, the EST clone 2989064 was purchased and the cDNA insert was obtained and sequenced in its entirety. The sequence of this cDNA insert is shown in FIG. 195 and is herein designated as "DNA73742-1662".

The full length clone shown in FIG. 195 contained a single open reading frame with an apparent translational initiation site at nucleotide positions 70 to 72 and ending at the stop codon found at nucleotide positions 514 to 516 (FIG. 195; SEQ ID NO:335). The predicted polypeptide precursor (FIG. 196, SEQ ID NO:335) is 148 amino acids long. Other features of the PRO1508 protein include: a signal sequence at about amino acids 1–30; a tyrosine kinase phosphorylation motif at about amino acids 96–103; and N-myristoylation motifs at about amino acids 27–32, 28–33, and 140–145. PRO1508 has a calculated molecular weight of approximately 17,183 daltons and an estimated pI of approximately 8.77. Clone DNA73742-1662 was deposited with the ATCC on Oct. 6, 1998 and is assigned ATCC deposit no. 203316.

An analysis of the Dayhoff database (version 35.45 SwissProt 35), using a WU-BLAST2 sequence alignment analysis of the full-length sequence shown in FIG. 196 (SEQ ID NO:336), revealed some homology between the PRO1508 amino acid sequence and the following Dayhoff sequences: HSAJ3728_1; P_R74962; P_R74941; AF053074_1; F69515; S20706; RPB1_PLAFD; A20587_1; A51861_1; and S75947.

Example 102

Isolation of cDNA Clones Encoding Human PRO1555

Use of the signal sequence algorithm described in Example 3 above allowed identification of an EST cluster sequence from the LIFESEQ® database, designated EST cluster no. 521, and also referred to herein as "DNA10316". This EST cluster sequence was then compared to a variety of expressed sequence tag (EST) databases which included public EST databases (e.g., GenBank) and the LIFESEQ® database to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated "DNA56374".

In light of the sequence homology between the DNA56374 sequence and an EST sequence contained within Incyte EST no.2855769, EST no.2855769 was purchased and the cDNA insert was obtained and sequenced. EST no. 2855769 was derived from a library constructed from female breast fat tissue. The sequence of this cDNA insert is shown in FIG. 197 and is herein designated as DNA73744-1665.

The full length clone shown in FIG. 197 contained a single open reading frame with an apparent translational initiation site at nucleotide positions 90 to 92 and ending at the stop codon found at nucleotide positions 828 to 830 (FIG. 197; SEQ ID NO:337). The predicted polypeptide precursor (FIG. 198, SEQ ID NO:338) is 246 amino acids long. PRO1555 has a calculated molecular weight of approximately 26,261 daltons and an estimated pI of approximately 5.65. Additional features include: a signal peptide at about amino acids 1–31; transmembrane domains at about amino acids 11–31 and 195–217; a potential N-glycosylation site at about amino acids 111–114; potential casein kinase II phosphorylation sites at about amino acids 2–5, 98–101, and 191–194; and potential N-myristoylation sites at about amino acids 146–151, and 192–197.

An analysis of the Dayhoff database (version 35.45 SwissProt 35), using a WU-BLAST2 sequence alignment analysis of the full-length sequence shown in FIG. 198 (SEQ ID NO:338), revealed some homology between the PRO1555 amino acid sequence and the following Dayhoff sequences: YKA4_CAEEL, AB014541_1, HVSX99518_2, SSU63019_1, GEN14286, MMU68267_1, XP2_XENLA, ICP4_HSV11, P_W40200, and AE001360_1.

Clone DNA73744-1665 was deposited with the ATCC on Oct. 6, 1998, and is assigned ATCC deposit no. 203322.

Example 103

Isolation of cDNA Clones Encoding Human PRO1485

A consensus DNA sequence was assembled relative to other EST sequences using phrap as described in Example 1 above. This consensus sequence is designated herein "DNA44791". Based on the DNA44791 consensus sequence, oligonucleotides were synthesized: 1) to identify by PCR a cDNA library that contained the sequence of interest, and 2) for use as probes to isolate a clone of the full-length coding sequence for PRO1485.

PCR primers (2 forward and 2 reverse) were synthesized:
forward PCR primer 1: 5'CCCTCCAAGGATGACAAAG-GCGC 3' (SEQ ID NO:341);
forward PCR primer 2: 5'GGTCAGCAGCTTTCTTGC-CCTAAATCAGG 3' (SEQ ID NO:342);
reverse PCR primer 1: 5'ATCTCAGGCGGCATCCTGT-CAGCC 3' (SEQ ID NO:343); and
reverse PCR primer 2: 5'GTGGATGCCTGCAAGAAGGT-TGGG 3' (SEQ ID NO:344).

Additionally, a synthetic oligonucleotide hybridization probe was constructed from the consensus DNA44791 sequence which had the following nucleotide sequence: hybridization probe 5'AGCTTTCTTGCCCTAAATCAG-GCCAGCCTCATCAGTCGCTGTGAC 3' (SEQ ID NO:345)

In order to screen several libraries for a source of a full-length clone, DNA from the libraries was screened by PCR amplification with the PCR primer pair identified above. A positive library was then used to isolate clones encoding the PRO1485 gene using the probe oligonucleotide and one of the PCR primers. RNA for construction of the cDNA libraries was isolated from human testis.

DNA sequencing of the clones isolated as described above gave the full-length DNA sequence for PRO1485 (designated herein as DNA73746-1654 [FIG. 199, SEQ ID NO:339]; and the derived protein sequence for PRO1485.

The entire coding sequence of PRO1485 is shown in FIG. 199 (SEQ ID NO:339). Clone DNA73746-1654 contains a single open reading frame with an apparent translational initiation site at nucleotide positions 151–153 and an apparent stop codon at nucleotide positions 595–597 of SEQ ID NO:339. The predicted polypeptide precursor is 148 amino acids long. The signal peptide is at about amino acids 1–18 of SEQ ID NO:340. The lysozyme C signature, CAAX box, and an N-gycosylation site are shown in FIG. 200. Clone DNA73746-1654 has been deposited with ATCC and is assigned ATCC deposit no. 203411. The full-length PRO1485 protein shown in FIG. 200 has an estimated molecular weight of about 16,896 daltons and a pI of about 6.05.

An analysis of the Dayhoff database (version 35.45 SwissProt 35), using a WU-BLAST2 sequence alignment analysis of the full-length sequence shown in FIG. 200 (SEQ ID NO:340), revealed sequence identity between the PRO1485 amino acid sequence and the following Dayhoff sequences: LYC_PHACO, P_R76684, 2HFL_Y, JC2144, JC5544, JC5555, JC5369, LYC2_PIG, P_R12113, and JC5380.

Example 104

Isolation of cDNA Clones Encoding Human PRO1564

A consensus DNA sequence was assembled relative to other EST sequences using phrap as described in Example 1 above. This consensus sequence is herein designated DNA67213. Based on the DNA67213 consensus sequence, oligonucleotides were synthesized: 1) to identify by PCR a cDNA library that contained the sequence of interest, and 2) for use as probes to isolate a clone of the full-length coding sequence for PRO1564.

PCR primers (forward and reverse) were synthesized:
forward PCR primer (67213.f1) 5'-GGAGAGGTGGTGGCCATGGACAG-3' (SEQ ID NO:348)
reverse PCR primer (67213.r1) 5'-CTGTCACTGCAAGGAGCCAACACC-3' (SEQ ID NO:349)
Additionally, a synthetic oligonucleotide hybridization probe was constructed from the consensus DNA67213 sequence which had the following nucleotide sequence hybridization probe (67213.p1) 5'-TATGTCGCTGCGAGGTGGTGAAAACCTCGAACTGTCTTTCAAGGC-3' (SEQ ID NO:350)

In order to screen several libraries for a source of a full-length clone, DNA from the libraries was screened by PCR amplification with the PCR primer pair identified above. A positive library was then used to isolate clones encoding the PRO1564 gene using the probe oligonucleotide and one of the PCR primers. RNA for construction of the cDNA libraries was isolated from human breast carcinoma tissue.

DNA sequencing of the clones isolated as described above gave the full-length DNA sequence for PRO1564 (designated herein as DNA73760-1672 [FIG. 201, SEQ ID NO:346]; and the derived protein sequence for PRO1564.

The entire nucleotide sequence of DNA73760-1672 is shown in FIG. 201 (SEQ ID NO:346). Clone DNA73760-1672 contains a single open reading frame with an apparent translational initiation site at nucleotide positions 462–464 and ending at the stop codon at nucleotide positions 2379–2381 (FIG. 201). The predicted polypeptide precursor is 639 amino acids long (FIG. 202). The full-length PRO1564 protein shown in FIG. 202 has an estimated molecular weight of about 73,063 daltons and a pI of about 6.84. Analysis of the full-length PRO1564 sequence shown in FIG. 202 (SEQ ID NO:347) evidences the presence of the following: a signal peptide from about amino acid 1 to about amino acid 28, a trasnmembrane domain from about amino acid 11 to about amino acid 36, potential N-glycosylation sites from about amino acid 107 to about amino acid 110 and from about amino acid 574 to about amino acid 577, a tyrosine kinase phosphorylation site from about amino acid 50 to about amino acid 57, potential N-myristolation sites from about amino acid 158 to about amino acid 163, from about amino acid 236 to about amino acid 241, from about amino acid 262 to about amino acid 267, from about amino acid 270 to about amino acid 275, from about amino acid 380 to about amino acid 385 and from about amino acid 513 to about amino acid 518, an amidation site from about amino acid 110 to about amino acid 113 and a prokaryotic membrane lipoprotein lipid attachment site from about amino acid 15 to about amino acid 25. Clone DNA73760-1672 has been deposited with ATCC on Oct. 6, 1998 and is assigned ATCC deposit no.203314.

An analysis of the Dayhoff database (version 35.45 SwissProt 35), using a WU-BLAST2 sequence alignment analysis of the full-length sequence shown in FIG. 202 (SEQ ID NO:347), evidenced significant homology between the PRO1564 amino acid sequence and the following Dayhoff sequences: MMU73819_1, HSY08564_1, P_W34470, P_R66402, PAGT_HUMAN, CEGLY5B_1, CEGLY6A_1, CEGLY6B_1, AP000006_308 and E69322.

Example 105

Isolation of cDNA Clones Encoding Human PRO1755

Use of the signal sequence algorithm described in Example 3 above allowed identification of an EST cluster sequence from the LIFESEQ® database, designated EST Cluster No. 141872. This EST cluster sequence was then compared to a variety of ESTs from the databases listed above to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated "DNA55731".

In light of the sequence homology between the DNA55731 sequence and a sequence contained within Incyte EST no. 257323, the EST clone was purchased and the cDNA insert was obtained and sequenced. Incyte clone 257323 was derived from a library constructed using RNA isolated from the hNT2 cell line (Stratagene library no. STR9372310), which was derived from a human teratocarcinoma that exhibited properties characteristic of a committed neuronal precursor at an early stage of development. The sequence of this cDNA insert is shown in FIG. 203 and is herein designated "DNA76396-1698". Alternatively, the DNA76396-1698 sequence can be obtained by preparing oligonucleotide probes and primers and isolating the sequence from an appropriate library (e.g. STR9372310).

The full length clone shown in FIG. 203 contained a single open reading frame with an apparent translational initiation site at nucleotide positions 58 to 60 and ending at the stop codon found at nucleotide positions 886 to 888 (FIG. 203; SEQ ID NO:351). The predicted polypeptide precursor (FIG. 204, SEQ ID NO:352) is 276 amino acids long. PRO1755 has a calculated molecular weight of approximately 29,426 daltons and an estimated pI of approximately 9.40. Additional features include: a signal peptide sequence at about amino acids 1–31; a transmembrane domain at about amino acids 178–198; a cAMP and cGMP-dependent protein kinase phosphorylation site at about amino acids 210–213; potential N-myristoylation sites at about amino acids 117–122, 154–149, and 214–219; and a cell attachment sequence at about amino acids 149–151.

An analysis of the Dayhoff database (version 35.45 SwissProt 35), using a WU-BLAST2 sequence alignment analysis of the full-length sequence shown in FIG. 204 (SEQ ID NO:352), revealed some homology between the PRO1755 amino acid sequence and the following Dayhoff sequences: APG-BRANA, P_R37743, NAU88587_1, YHL1_EBV, P_W31855, CET10B10_4, AF039404_1, PRP1_HUMAN, AF038575_1, and AF053091_1.

Clone DNA76396-1698 was deposited with the ATCC on Nov. 17, 1998, and is assigned ATCC deposit no. 203471.

Example 106

Isolation of cDNA Clones Encoding Human PRO1757

Use of the signal sequence algorithm described in Example 3 above allowed identification of three EST sequences from the Incyte database, designated Incyte EST clones no. 2007947, 2014962 and 1912034. These EST sequences were then clustered and assembled into a consensus DNA sequence with the program "phrap" (Phil Green, University of Washington, Seattle, Wash.). The consensus sequence obtained therefrom is herein designated as DNA56054.

In light of the sequence homology between the DNA56054 sequence and a sequence contained within the Incyte EST clone no. 2007947, the Incyte EST clone no. 2007947 was purchased and the cDNA insert was obtained and sequenced. The sequence of this cDNA insert is shown in FIG. 205 and is herein designated as DNA76398-1699.

Clone DNA76398-1699 contains a single open reading frame with an apparent translational initiation site at nucleotide positions 59–61 and ending at the stop codon at nucleotide positions 422–424 (FIG. 205). The predicted polypeptide precursor is 121 amino acids long (FIG. 206). The full-length PRO1757 protein shown in FIG. 206 has an estimated molecular weight of about 12,073 daltons and a pI of about 4.11. Analysis of the full-length PRO1757 sequence shown in FIG. 206 (SEQ ID NO:354) evidences the presence of the following: a signal peptide from about amino acid 1 to about amino acid 19, a transmembrane domain from about amino acid 91 to about amino acid 110, a glycosaminoglycan attachment site from about amino acid 44 to about amino acid 47, a cAMP- and cGMP-dependent protein kinase phosphorylation site from about amino acid 116 to about amino acid 119 and a potential N-myristolation site from about amino acid 91 to about amino acid 96. Clone DNA76398-1699 has been deposited with ATCC on Nov. 17, 1998 and is assigned ATCC deposit no. 203–474.

An analysis of the Dayhoff database (version 35.45 SwissProt 35), using a WU-BLAST2 sequence alignment analysis of the full-length sequence shown in FIG. 206 (SEQ ID NO:354), evidenced significant homology between the PRO1757 amino acid sequence and the following Dayhoff sequences: JQ0964, COLL_HSVS7, HSU70136_1, AF003473_1, D89728_1, MTF1_MOUSE, AF029777_1, HSU88153_1 and P_W05321.

Example 107

Isolation of cDNA Clones Encoding Human PRO1758

Use of the signal sequence algorithm described in Example 3 above allowed identification of an EST cluster sequence from the LIFESEQ® database, designated EST cluster No. 20926. This EST cluster sequence was then compared to a variety of expressed sequence tag (EST) from the databases mentioned above, to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56260.

In light of the sequence homology between the DNA56260 sequence and a sequence contained within EST no. 2936330 from the LIFESEQ® database, the EST clone, which originated from a library constructed from thymus tissue of a fetus that died from anencephalus, was purchased and the cDNA insert was obtained and sequenced. The sequence of this cDNA insert is shown in FIG. 207 and is herein designated as DNA76399-1700.

The full length clone shown in FIG. 207 contained a single open reading frame with an apparent translational initiation site at nucleotide positions 78 to 80 and ending at the stop codon found at nucleotide positions 549–551 (FIG. 207; SEQ ID NO:355). The predicted polypeptide precursor (FIG. 208, SEQ ID NO:356) is 157 amino acids long. PRO1758 has a calculated molecular weight of approximately 17,681 daltons and an estimated pI of approximately 7.65. Additional features include: a signal peptide from about amino acids 1–15; a potential N-glycosylation site at about amino acids 24–27; a cAMP- and cGMP-dependent protein kinase phosphorylation site at about amino acids 27–30; a casein kinase H phosphorylation site at about amino acids 60–63; potential N-myristoylation sites at about amino acids 17–22, 50–55, 129–134, and 133–138; a cell attachment sequence at about amino acids 153–155; and a cytochrome c family heme-binding site signature at about amino acids 18–23.

An analysis of the Dayhoff database (version 35.45 SwissProt 35), using a WU-BLAST2 sequence alignment analysis of the full-length sequence shown in FIG. 208 (SEQ ID NO:356), revealed significant homology between the PRO1758 amino acid sequence and Dayhoff sequence no AC005328_2. Homology was also found between the PRO1758 amino acid sequence and Dayhoff sequence no. CELC46F2_1.

Clone DNA76399-1700 was deposited with the ATCC on Nov. 17, 1998 and is assigned ATCC deposit no. 203472.

Example 108

Isolation of cDNA Clones Encoding Human PRO1575

A consensus DNA sequence was assembled relative to other EST sequences using phrap as described in Example 1 above. This consensus sequence is designated herein as "DNA35699". Based on the DNA35699 consensus sequence, oligonucleotides were synthesized: 1) to identify by PCR a cDNA library that contained the sequence of interest, and 2) for use as probes to isolate a clone of the full-length coding sequence for PRO1575.

PCR primers (forward and reverse) were synthesized:
forward PCR primers: CCAGCAGTGCCCATACTCCAT-AGC (35699. f1; SEQ ID NO:359); TGACGAGTGG-GATACACTGC (35699. f2; SEQ ID NO:360)
reverse PCR primer: GCTCTACGGAAACTTCTGCT-GTGG (35699. r1; SEQ ID NO:361)

Additionally, a synthetic oligonucleotide hybridization probe was constructed from the consensus DNA35699 sequence which had the following nucleotide sequence:
hybridization probe: ATTCCCAGGCGTGTCATTTGG-GATCAGCACTGATTCTGAGGTTCTGACAC (35699.p1; SEQ ID NO:362)

In order to screen several libraries for a source of a full-length clone, DNA from the libraries was screened by PCR amplification with the PCR primer pair identified above. A positive library was then used to isolate clones encoding the PRO1575 gene using the probe oligonucleotide and one of the PCR primers. RNA for construction of the cDNA libraries was isolated from human pancreatic tissue.

DNA sequencing of the clones isolated as described above gave the full-length DNA sequence for PRO1575 (designated herein as DNA76401-1683 [FIG. 209, SEQ ID NO:357]; and the derived protein sequence for PRO1575.

The entire coding sequence of PRO1575 is shown in FIG. 209 (SEQ ID NO:357). Clone DNA76401-1683 contains a single open reading frame with an apparent translational initiation site at nucleotide positions 22–24 and an apparent stop codon at nucleotide positions 841–843. The predicted polypeptide precursor is 273 amino acids long. The full-length PRO1575 protein shown in FIG. 210 has an estimated molecular weight of about 30,480 daltons and a pI of about 4.60. Additional features include: a signal peptide at about amino acids 1–20; a transmembrane domain at about amino acids 143–162; a potential N-glycosylation site at about amino acids 100–103; and potential N-myristoylation sites at about amino acids 84–89, 103–108, 154–159, and 201–206.

An analysis of the Dayhoff database (version 35.45 SwissProt 35), using a WU-BLAST2 sequence alignment analysis of the full-length sequence shown in FIG. 210 (SEQ ID NO:358), revealed significant homology between the PRO1575 amino acid sequence and Dayhoff sequence A12005_1. Homology was also revealed between the PRO1575 amino acid sequence and the following additional Dayhoff sequences: P_P80615; P_R25297; P_R51696; A47300; PDI_DROME; P_R49829; P_R63807; DMALPADAP_1; and DRZNF6_1.

Clone DNA76401-1683 was deposited with the ATCC on Oct. 20, 1998, and is assigned ATCC deposit no. 203360.

Example 109

Isolation of cDNA Clones Encoding Human PRO1787

A consensus DNA sequence was assembled relative to other EST sequences using phrap to form an assembly as described in Example 1 above. This consensus sequence is designated herein "DNA45123". Based on homology of DNA45123 to Incyte EST 3618549 identified in the assembly, as well as other discoveries and information provided herein, the clone including this EST was purchased and sequenced. DNA sequencing of the clone gave the full-length DNA sequence for PRO1787 and the derived protein sequence for PRO1787.

The entire coding sequence of PRO1787 is included in FIG. 211 (SEQ ID NO:363). Clone DNA76510-2504 contains a single open reading frame with an apparent translational initiation site at nucleotide positions 163–165 and an apparent stop codon at nucleotide positions 970–972 of SEQ ID NO:363. The approximate locations of the signal peptide, transmembrane domain, N-glycosylation sites, N-myristoylation sites and a kinase phosphorylation site are indicated in FIG. 212. The predicted polypeptide precursor is 269 amino acids long. Clone DNA76510-2504 has been deposited with the ATCC and is assigned ATCC deposit no. 203477. The full-length PRO1787 protein shown in FIG. 212 has an estimated molecular weight of about 29,082 daltons and a pI of about 9.02.

An analysis of the Dayhoff database (version 35.45 SwissProt 35), using a WU-BLAST2 sequence alignment analysis of the full-length sequence shown in FIG. 212 (SEQ ID NO:364), revealed sequence identity between the PRO1787 amino acid sequence and the following Dayhoff sequences: MYP0_RAT, MYP0_HUMAN, MYP0_BOVIN, GEN12838, HSSCN2B2_1, AF007783_1, HSU90716_1, P_W42015, XLU43330_1 and AF060231_1.

Example 110

Isolation of cDNA Clones Encoding Human PRO1781

Initial DNA sequences referred to herein as DNA58070 and DNA56340 were identified using a yeast screen, in a human SK-Lu-1 adenocarcinoma cell line cDNA library that preferentially represents the 5' ends of the primary cDNA clones. These sequences were clustered and assembled into a consensus DNA sequence using the computer program "phrap" (Phil Green, University of Washington, Seattle, Wash.). The consensus sequence is designated herein as "DNA59575".

Based on the DNA59575 consensus sequence, the following oligonucleotides, were synthesized for use as probes to isolate a clone of the full-length coding sequence for PRO1781 from a human fetal lung cDNA library: TGGAAAAGAAGTCTGGTCAGAAGGTTTAGG (SEQ ID NO:367), CATTTGGCTTCATTCTCCTGCTCTG (SEQ ID NO:368), AAAACCTCAGAACAACTCATTTTG-CACC (SEQ ID NO:369) and GTCTCACCATGGT-TGCTCTTGCCAAATTGTGGGAAGCAGGG (SEQ ID NO:370).

The full length DNA76522-2500 clone shown in FIG. 213 contained a single open reading frame with an apparent translational initiation site at nucleotide positions 21 to 23 and ending at the stop codon found at nucleotide positions 1141–1143 (FIG. 213; SEQ ID NO:365). The predicted polypeptide precursor (FIG. 214, SEQ ID NO:366) is 373 amino acids long. PRO1781 has a calculated molecular weight of approximately 41,221 daltons and an estimated pI of approximately 8.54. Additional features include: a possible signal peptide at about amino acids 1–19; a transmembrane domain at about amino acids 39–60; a tyrosine phosphorylation site at about amino acids 228–236; potential N-myristoylation sites at about amino acids 16–21, 17–22, 43–48, 45–50, 47–52, 49–54, 53–58, 58–63, 59–64, 62–67, 126–131, and 142–147; amidation sites at about amino acids 22–25 and 280–283; and a prokaryotic membrane lipoprotein lipid attachment site at about amino acids 12–22.

An analysis of the Dayhoff database (version 35.45 SwissProt 35), using a WU-BLAST2 sequence alignment analysis of the full-length sequence shown in FIG. 214 (SEQ ID NO:366), revealed some homology between the PRO1781 amino acid sequence and the following Dayhoff sequences: CEY4510D_5, AP000001_146, P_R10676, DAC_STRSQ, CEC40H5_5, P_R35204, KPU58495_1, KPN16781_1, AF010403_1, and AF056116_14.

Clone DNA76522-2500 was deposited with the ATCC on Nov. 17, 1998, and is assigned ATCC deposit no. 203469.

Example 111

Isolation of cDNA Clones Encoding Human PRO1556

Use of the signal sequence algorithm described in Example 3 above allowed identification of an EST cluster sequence from the LIFESEQ® database, designated EST Cluster No. 103158, and also referred to herein as "DNA10398". This EST cluster sequence was then compared to a variety of expressed sequence tag (EST) databases which included public EST databases (e.g., GenBank) and the LIFESEQ® database, to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA56417.

In light of the sequence homology between the DNA56417 sequence and a sequence contained within Incyte EST no. 959332, EST no. 959332 was purchased and the cDNA insert was obtained and sequenced. The sequence of this cDNA insert is shown in FIG. 215 and is herein designated as DNA76529-1666.

The full length clone shown in FIG. 215 contained a single open reading frame with an apparent translational initiation site at nucleotide positions 85 to 87 and ending at the stop codon found at nucleotide positions 892 to 894 (FIG. 215; SEQ ID NO:371). The predicted polypeptide precursor (FIG. 216, SEQ ID NO:372) is 269 amino acids long. PRO1556 has a calculated molecular weight of approximately 28,004 daltons and an estimated pI of approximately 5.80. Additional features include: a signal peptide sequence at about amino acids 1–24; transmembrane domains at about amino acids 11–25 and 226–243; a potential N-glycosylation site at about amino acids 182–185, potential cAMP- and cGMP-dependent protein kinase phosphorylation site at about amino acids 70–73; and potential N-myristoylation sites at about amino acids 29–34, 35–39, 117–122, 121–126, 125–130, 154–159, 166–171, 241–246, 246–251, 247–252, 249–254, 250–255, 251–256, 252–257, 253–258, 254–259, 255–260, 256–261, 257–262, and 259–264.

An analysis of the Dayhoff database (version 35.45 SwissProt 35), using a WU-BLAST2 sequence alignment analysis of the full-length sequence shown in FIG. 216 (SEQ ID NO:372), revealed some homology between the PRO1556 amino acid sequence and the following Dayhoff sequences: T8F5_4, R23B_MOUSE, CANS_HUMAN, P_W41640, DSU51091_1, TP2B_CHICK, DVU20660_1, S43296, P_R23962, and BRN1_HUMAN.

Clone DNA76529-1666 was deposited with the ATCC on Oct. 6, 1998, and is assigned ATCC deposit no. 203315.

Example 112

Isolation of cDNA Clones Encoding Human PRO1759

Use of the signal sequence algorithm described in Example 3 above allowed identification of an EST cluster sequence from the Incyte database, designated DNA10571. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from pooled eosinophils of allergic asthmatic patients. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA57313.

In light of the sequence homology between the DNA57313 sequence and the Incyte EST 2434255, the clone including this EST was purchased and the cDNA insert was obtained and sequenced. The sequence of this cDNA insert is shown in FIG. 217 and is herein designated as DNA76531-1701.

The full length clone shown in FIG. 217 contained a single open reading frame with an apparent translational initiation site at nucleotide positions 125–127 and ending at the stop codon found at nucleotide positions 1475–1477 (FIG. 217; SEQ ID NO:373). The approximate locations of the signal peptide and transmembrane domains are indicated in FIG. 218, whereas the approximate locations for N-myristoylation sites, a lipid attachment site, an amidation site and a kinase phosphorylation site are indicated in FIG. 218. The predicted polypeptide precursor (FIG. 218, SEQ ID NO:374) is 450 amino acids long. PRO1759 has a calculated molecular weight of approximately 49,765 daltons and an estimated pI of approximately 8.14. Clone DNA76531-1701 was deposited with the ATCC on Nov. 17, 1998 and is assigned ATCC deposit no. 203465.

An analysis of the Dayhoff database (version 35.45 SwissProt 35), using a WU-BLAST2 sequence alignment analysis of the full-length sequence shown in FIG. 218 (SEQ ID NO:374), revealed sequence identity between the PRO1759 amino acid sequence and the following Dayhoff sequences: OPDE_PSEAE, TH11_TRYBB, S67684, RGT2_YEAST, S68362, ATSUGTRPR_1, P_W17836 (Patent application WO9715668-A2), F69587, A48076, and A45611.

Example 113

Isolation of cDNA Clones Encoding Human PRO1760

Use of the signal sequence algorithm described in Example 3 above allowed identification of an EST cluster sequence from the Incyte database. This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. One or more of the ESTs was derived from a prostate tumor library. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated DNA58798.

In light of the sequence homology between DNA58798 sequence and the Incyte EST 3358745, the clone including this EST was purchased and the cDNA insert was obtained and sequenced. The sequence of this cDNA insert is shown in FIG. 219 and is herein designated as DNA76532-1702.

The full length clone shown in FIG. 219 contained a single open reading frame with an apparent translational initiation site at nucleotide positions 60–62 and ending at the stop codon found at nucleotide positions 624–626 (FIG. 219; SEQ ID NO:375). The predicted polypeptide precursor (FIG. 220, SEQ ID NO:376) is 188 amino acids long. Motifs are further indicated in FIG. 220. PRO1760 has a calculated molecular weight of approximately 21,042 daltons and an estimated pI of approximately 5.36. Clone DNA76532-1702 was deposited with the ATCC on Nov. 17, 1998 and is assigned ATCC deposit no. 203473.

An analysis of the Dayhoff database (version 35.45 SwissProt 35), using a WU-BLAST2 sequence alignment analysis of the full-length sequence shown in FIG. 220 (SEQ ID NO:376), revealed sequence identity between the PRO1760 amino acid sequence and the following Dayhoff sequences: CELT07F12_2, T22J18_16, ATF1C12_3, APE3_YEAST, P_W22471, SAU56908_1, SCPA_STRPY, ATAC00423817, SAPURCLUS_2 and AF041468_9.

Example 114

Isolation of cDNA Clones Encoding Human PRO1561

A consensus DNA sequence was assembled relative to other EST sequences using phrap and repeated cycles of BLAST and phrap to extend a sequence as far as possible using the EST sequences discussed above as described in Example 1 above. This consensus sequence is herein designated DNA40630. Based on the DNA40630 consensus sequence, oligonucleotides were synthesized: 1) to identify by PCR a cDNA library that contained the sequence of interest, and 2) for use as probes to isolate a clone of the full-length coding sequence for PRO1561.

PCR primers (forward and reverse) were synthesized:
forward PCR primer (40630.f1)
5'-CTGCCTCCACTGCTCTGTGCTGGG-3' (SEQ ID NO:379)
reverse PCR primer (40630.r1)
5'-CAGAGCAGTGGATGTTCCCCTGGG-3' (SEQ ID NO:380)

Additionally, a synthetic oligonucleotide hybridization probe was constructed from the consensus DNA40630 sequence which had the following nucleotide sequence
hybridization probe (40630.1)
5'-CTGAACAAGATGGTCAAGCAAGTGACTGGGAA
AATGCCCATCCTC-3' (SEQ ID NO:381)

In order to screen several libraries for a source of a full-length clone, DNA from the libraries was screened by PCR amplification with the PCR primer pair identified above. A positive library was then used to isolate clones encoding the PRO1561 gene using the probe oligonucleotide and one of the PCR primers. RNA for construction of the cDNA libraries was isolated from human breast tumor tissue.

DNA sequencing of the clones isolated as described above gave the full-length DNA sequence for PRO1561 (designated herein as DNA76538-1670 [FIG. 221, SEQ ID NO:377]; and the derived protein sequence for PRO1561.

The entire nucleotide sequence of DNA76538-1670 is shown in FIG. 221 (SEQ ID NO:377). Clone DNA76538-1670 contains a single open reading frame with an apparent translational initiation site at nucleotide positions 29–31 and ending at the stop codon at nucleotide positions 377–379 (FIG. 221). The predicted polypeptide precursor is 116 amino acids long (FIG. 222). The full-length PRO1561 protein shown in FIG. 222 has an estimated molecular weight of about 12,910 daltons and a pI of about 6.41. Analysis of the full-length PRO1561 sequence shown in FIG. 222 (SEQ ID NO:378) evidences the presence of the following: a signal peptide from about amino acid 1 to about amino acid 17, a transmembrane domain from about amino acid 1 to about amino acid 24, a potential N-glycosylation site from about amino acid 86 to about amino acid 89, potential N-myristolation sites from about amino acid 20 to about amino acid 25 and from about amino acid 45 to about amino acid 50 and a phospholipase A2 histidine active site from about amino acid 63 to about amino acid 70. Clone DNA76538-1670 has been deposited with ATCC on Oct. 6, 1998 and is assigned ATCC deposit no. 203313.

An analysis of the Dayhoff database (version 35.45 SwissProt 35), using a WU-BLAST2 sequence alignment analysis of the full-length sequence shown in FIG. 222 (SEQ ID NO:378), evidenced significant homology between the PRO1561 amino acid sequence and the following Dayhoff sequences: P_R63053, P_R25416, P_R63055, P_P93363, P_R63046, PA2A_VIPAA, P_W58476, GEN13747, PA2X_HUMAN and PA2A_CRODU.

In addition to the above, a sequence homology search evidenced significant homology between the DNA40630 consensus sequence and Incyte EST clone no. 1921092. As such, Incyte EST clone no. 1921092 was purchased and the insert obtained and sequenced, thereby giving rise to the DNA76538-1670 sequence shown in FIG. 221 (SEQ ID NO:377).

Example 115

Isolation of cDNA Clones Encoding Human PRO1567

A cDNA sequence isolated in the amylase screen described in Example 2 above is herein designated DNA47580. The DNA47580 sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., *Methods in Enzymology* 266:460–480 (1996)). Those comparisons resulting in a BLAST score of 70 (or in some cases 90) or greater that did not encode known proteins were clustered and assembled into consensus DNA sequences with the program "phrap" (Phil Green, University of Washington, Seattle, Wash.). The consensus sequence obtained therefrom is herein designated "DNA57246".

In light of the sequence homology between the DNA57246 sequence and EST no. 1793996 from the LIFESEQ® database, the clone containing the EST no. 1793996, which originates from a library constructed from prostate tumor tissue, was purchased and the cDNA insert was obtained and sequenced. The sequence of this cDNA insert is shown in FIG. 223 (SEQ ID NO:382) and is herein designated as DNA76541-1675.

A full length clone was identified that contained a single open reading frame with an apparent translational initiation site at nucleotide positions 109–111, and a stop signal at nucleotide positions 643–645 (FIG. 223; SEQ ID NO:382). The predicted polypeptide precursor is 178 amino acids long has a calculated molecular weight of approximately 19,600 daltons and an estimated pI of approximately 5.89. Additional features include a signal peptide at about amino acids 1–22; a potential N-glycosylation site at about amino acids 167–170; a protein kinase C phosphorylation site at about amino acids 107–109; and potential N-myristoylation sites at about amino acids 46–51, 72–77, and 120–125.

An analysis of the Dayhoff database (version 35.45 SwissProt 35), using a WU-BLAST2 sequence alignment analysis of the full-length sequence shown in FIG. 224 (SEQ ID NO:383), evidenced significant homology between the PRO1567 amino acid sequence and human colon specific gene CSG6 polypeptide designated Dayhoff sequence "P_W06549". Homology was also found between the PRO1567 amino acid sequence and the following additional Dayhoff sequences: HUAC002301_1, P_246880, A49685, SPBP_RAT, S42924, SPBP_MOUSE, I52115, MMU03711_1, and AF041468_31.

Clone DNA76541-1675 has been deposited with the ATCC on Oct. 27, 1998, and is assigned ATCC deposit no. 203409.

Example 116

Isolation of cDNA Clones Encoding Human PRO1693

A consensus DNA sequence was assembled relative to other EST sequences using phrap as described in Example 1 above. This consensus sequence is herein designated DNA38251. Based on the DNA38251 consensus sequence, oligonucleotides were synthesized: 1) to identify by PCR a cDNA library that contained the sequence of interest, and 2) for use as probes to isolate a clone of the full-length coding sequence for PRO1693.

PCR primers (forward and reverse) were synthesized:
forward PCR primer (38251.f1)
5'-CTGGGATCTGAACAGTTTCGGGGC-3' (SEQ ID NO:386)
reverse PCR primer (38251.r1)
5'-GGTCCCCAGGACATGGTCTGTCCC-3' (SEQ ID NO:387)
Additionally, a synthetic oligonucleotide hybridization probe was constructed from the consensus DNA38251 sequence which had the following nucleotide sequence
hybridization probe (38251.p1)
5'-GCTGAGTTTACATTTACGGTCTAACTCCCTGAGAACCATCCCTGTGCG-3' (SEQ ID NO:388)

In order to screen several libraries for a source of a full-length clone, DNA from the libraries was screened by PCR amplification with the PCR primer pair identified above. A positive library was then used to isolate clones encoding the PRO1693 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1693 (designated herein as DNA77301-1708 [FIG. 225, SEQ ID NO:384]; and the derived protein sequence for PRO1693.

The entire nucleotide sequence of DNA77301-1708 is shown in FIG. 225 (SEQ ID NO:384). Clone DNA77301-1708 contains a single open reading frame with an apparent translational initiation site at nucleotide positions 508–510 and ending at the stop codon at nucleotide positions 2047–2049 (FIG. 225). The predicted polypeptide precursor is 513 amino acids long (FIG. 226). The full-length PRO1693 protein shown in FIG. 226 has an estimated molecular weight of about 58,266 daltons and a pI of about 9.84. Analysis of the full-length PRO1693 sequence shown in FIG. 226 (SEQ ID NO:385) evidences the presence of the following: a signal peptide from about amino acid 1 to about amino acid 33, a transmembrane domain from about amino acid 420 to about amino acid 442, potential N-glycosylation sites from about amino acid 126 to about amino acid 129, from about amino acid 357 to about amino acid 360, from about amino acid 496 to about amino acid 499 and from about amino acid 504 to about amino acid 507, a cAMP- and cGMP-dependent protein kinase phosphorylation site from about amino acid 465 to about amino acid 468, a tyrosine kinase phosphorylation site from about amino acid 136 to about amino acid 142 and potential N-myristolation sites from about amino acid 11 to about amino acid 16, from about amino acid 33 to about amino acid 38, from about amino acid 245 to about amino acid 250, from about amino acid 332 to about amino acid 337, from about amino acid 497 to about amino acid 502 and from about amino acid 507 to about amino acid 512. Clone DNA77301-1708 has been deposited with ATCC on Oct. 27, 1998 and is assigned ATCC deposit no. 203407.

An analysis of the Dayhoff database (version 35.45 SwissProt 35), using a WU-BLAST2 sequence alignment analysis of the full-length sequence shown in FIG. 226 (SEQ ID NO:385), evidenced significant homology between the PRO1693 amino acid sequence and the following Dayhoff sequences: AB007876_1, ALS_MOUSE, HSCHON03_1, P_R85889, AF062006_1, AB014462_1, A58532, MUSLRRPA_1, AB007865_1 and AF030435_1.

Example 117

Isolation of cDNA Clones Encoding Human PRO1784

A cDNA sequence isolated in the amylase screen described in Example 2 above is herein designated DNA43862. Based on the DNA43862 sequence, oligonucleotide probes were generated and used to screen a human fetal kidney library prepared as described in paragraph 1 above. The cloning vector was pRK5B (pRKSB is a precursor of pRK5D that does not contain the SfiI site; see, Holmes et al., *Science,* 253:1278–1280 (1991)), and the cDNA size cut was less than 2800 bp.

PCR primers (forward and reverse) were synthesized:
forward PCR primer (f1)
5'-CTTTTCAGTGTCACCTCAGCGATCTC-3' (SEQ ID NO:391); and
reverse PCR primer (r1)
5'-CCAAAACATGGAGCAGGAACAGG-3' (SEQ ID NO:392).
Additionally, a synthetic oligonucleotide hybridization probe was constructed from the DNA43862 sequence which had the following nucleotide sequence:
hybridization probe (p1)
5'-CCAGTTGGTGCTCTCGGACCTACCATGCGAAG AAGATGAAATGTGTG-3' (SEQ ID NO:393).

In order to screen several libraries for a source of a full-length clone, DNA from the libraries was screened by PCR amplification with the PCR primer pair identified above. A positive library was then used to isolate clones encoding the PRO1784 gene using the probe oligonucleotide and one of the PCR primers.

A full length clone was identified that contained a single open reading frame with an apparent translational initiation site at nucleotide positions 68–70, and a stop signal at nucleotide positions 506–508 (FIG. 227; SEQ ID NO:389). The predicted polypeptide precursor is 146 amino acids long has a calculated molecular weight of approximately 16,116 daltons and an estimated pI of approximately 4.99. The approximate locations of the signal peptide, transmembrane domain and N-myristoylation site are indicated in FIG. 228. Clone DNA77303-2502 has been deposited with the ATCC and is assigned ATCC deposit no. 203479.

An analysis of the Dayhoff database (version 35.45 SwissProt 35), using a WU-BLAST2 sequence alignment analysis of the full-length sequence shown in FIG. 228 (SEQ ID NO:390), evidenced sequence identity between the PRO1784 amino acid sequence and the following Dayhoff sequences: RNU87224_1, RNAF000114_1, P_W31947, S18038, AE001300_8, AF039833_1, P_W39833_1, P_W39788, HSU87223_1, NTU06712_1, and P_W31946.

Example 118

Isolation of cDNA Clones Encoding Human PRO1605

A cDNA clone (DNA77648-1688) encoding a native human PRO1605 polypeptide was identified by a yeast screen, in a human fetal kidney cDNA library that preferentially represents the 5' ends of the primary cDNA clones.

The full-length DNA77648-1688 clone shown in FIG. 229 contains a single open reading frame with an apparent translational initiation site at nucleotide positions 425–427 and ending at the stop codon at nucleotide positions 845–847 (FIG. 229). The predicted polypeptide precursor is 140 amino acids long (FIG. 230). The full-length PRO1605 protein shown in FIG. 230 has an estimated molecular weight of about 15,668 daltons and a pI of about 10.14. Analysis of the full-length PRO1605 sequence shown in FIG. 230 (SEQ ID NO:395) evidences the presence of the following: a signal peptide from about amino acid 1 to about amino acid 26. Clone DNA77648-1688 has been deposited with ATCC on Oct. 27, 1998 and is assigned ATCC deposit no. 203408.

An analysis of the Dayhoff database (version 35.45 SwissProt 35), using a WU-BLAST2 sequence alignment analysis of the full-length sequence shown in FIG. 230 (SEQ ID NO:395), evidenced significant homology between the PRO1605 amino acid sequence and the following Dayhoff sequences: GNT5_HUMAN, P_R48975, P_W22519, MM26SPROT_1, HSU86782_1, CH60_LEPIN, HMCT_HELPY, F65126, HIU08875_1 and P_R41724.

Example 119

Isolation of cDNA Clones Encoding Human PRO1788

The extracellular domain (ECD) sequences (including the secretion signal sequence, if any) from about 950 known secreted proteins from the Swiss-Prot public database were used to search EST databases. The EST databases included public EST databases (e.g., GenBank), and a proprietary EST database (LIFESEQ®, Incyte Pharmaceuticals, Palo Alto, Calif.). The search was performed using the computer program BLAST or BLAST2 [Altschul et al., *Methods in Enzymology*, 266:460–480 (1996)] as a comparison of the ECD protein sequences to a 6 frame translation of the EST sequences. Incyte Clone No. 2968304 was identified as a sequence of interest having a BLAST score of 70 or greater that did not encode known proteins. The nucleotide sequence of Incyte Clone No. 2968304 is designated herein as "DNA6612".

In addition, the DNA6612 sequence was extended using repeated cycles of BLAST and phrap (Phil Green, University of Washington, Seattle, Wash.) to extend the sequence as far as possible using the sources of EST sequences discussed above. The extended consensus sequence is designated herein as "DNA49648". Based on the DNA49648 consensus sequence, oligonucleotides were synthesized: 1) to identify by PCR a cDNA library that contained the sequence of interest, and 2) for use as probes to isolate a clone of the full-length coding sequence for PRO1788.

PCR primers (forward and reverse) were synthesized:
forward PCR primer: CCCTGCCAGCCGAGAGCT-TCACC (49648. f1; SEQ ID NO:398)
reverse PCR primer: GGTTGGTGCCCGAAAGGTC-CAGC (49648. r1; SEQ ID NO:399)

Additionally, a synthetic oligonucleotide hybridization probe was constructed from the consensus DNA49648 sequence which had the following nucleotide sequence:
hybridization probe: CAACCCCAAGCT-TAACTGGGCAGGAGCTGAGGTGTTTTCAGGCC (49648.p1; SEQ ID NO:400)

In order to screen several libraries for a source of a full-length clone, DNA from the libraries was screened by PCR amplification with the PCR primer pair identified above. A positive library was then used to isolate clones encoding the PRO1788 gene using the probe oligonucleotide and one of the PCR primers. RNA for construction of the cDNA libraries was isolated from human fetal kidney tissue.

DNA sequencing of the clones isolated as described above gave the full-length DNA sequence for PRO1788 (designated herein as DNA77652-2505 [FIG. 231, SEQ ID NO:396]; and the derived protein sequence for PRO1788.

The entire coding sequence of PRO1788 is shown in FIG. 231 (SEQ ID NO:396). Clone DNA77652-2505 contains a single open reading frame with an apparent translational initiation site at nucleotide positions 64–66 and an apparent stop codon at nucleotide positions 1123–1125. The predicted polypeptide precursor is 353 amino acids long. The full-length PRO1788 protein shown in FIG. 232 has an estimated molecular weight of about 37,847 daltons and a pI of about 6.80. Additional features of PRO1788 include: a signal peptide at about amino acids 1–16; transmembrane domains at about amino acids 215–232 and 287–304; potential N-glycosylation sites at about amino acids 74–77 and 137–140; a glycosaminoglycan attachment site at about amino acids 45–48; a tyrosine kinase phosphorylation site at about amino acids 318–325; N-myristoylation sites at about amino acids 13–18, 32–37, 88–93, 214–219, and 223–228; and a leucine zipper pattern at about amino acids 284–305.

An analysis of the Dayhoff database (version 35.45 Swis-sProt 35), using a WU-BLAST2 sequence alignment analysis of the full-length sequence shown in FIG. 232 (SEQ ID NO:397), revealed significant homology between the PRO1788 amino acid sequence and the following Dayhoff sequences: AF030435_1; AF062006_1; DMTARTAN_1; GARP_HUMAN; S42799; P_R71294; HSU88879_1; DROWHEELER_1; A58532; and AF068920_1.

Clone DNA77652-2505 was deposited with the ATCC on Nov. 17, 1998, and is assigned ATCC deposit no. 203480.

Example 120

Isolation of cDNA Clones Encoding Human PRO1801

A proprietary expressed sequence tag (EST) DNA database (LIFESEQ®, Incyte Pharmaceuticals, Palo Alto, Calif.) was searched and an EST was identified which showed homology to the IL-19 protein. This EST sequence is Incyte EST clone no. 819592 and is herein designated DNA79293. Based on the DNA79293 sequence, oligonucleotides were synthesized: 1) to identify by PCR a cDNA library that contained the sequence of interest, and 2) for use as probes to isolate a clone of the full-length coding sequence for PRO1801.

PCR primers (forward and reverse) were synthesized:
forward PCR primer 5'-CTCCTGTGGTCTCCAGATTTCAGGCCTA-3' (SEQ ID NO:403)
reverse PCR primer 5'-AGTCCTCCTTAAGATTCTGATGTCAA-3' (SEQ ID NO:404)

RNA for construction of the cDNA libraries was isolated from human fetal kidney tissue. The cDNA libraries used to isolated the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

DNA sequencing of the clones isolated as described above gave the full-length DNA sequence for PRO1801 (designated herein as DNA83500-2506 [FIG. 233, SEQ ID NO:401]; and the derived protein sequence for PRO1801.

The entire nucleotide sequence of DNA83500-2506 is shown in FIG. 233 (SEQ ID NO:401). Clone DNA83500-2506 contains a single open reading frame with an apparent translational initiation site at nucleotide positions 109–111 and ending at the stop codon at nucleotide positions 892–894 (FIG. 233). The predicted polypeptide precursor is 261 amino acids long (FIG. 234). The full-length PRO1801 protein shown in FIG. 234 has an estimated molecular weight of about 29,667 daltons and a pI of about 8.76. Analysis of the full-length PRO1801 sequence shown in FIG. 234 (SEQ ID NO:402) evidences the presence of the following: a signal peptide from about amino acid 1 to about amino acid 42, cAMP- and cGMP-dependent protein kinase phosphorylation sites from about amino acid 192 to about amino acid 195 and from about amino acid 225 to about amino acid 228 and potential N-myristolation sites from about amino acid 42 to about amino acid 47, from about amino acid 46 to about amino acid 51 and from about amino acid 136 to about amino acid 141. Clone DNA83500-2506 has been deposited with ATCC on Oct. 29, 1998 and is assigned ATCC deposit no. 203391.

An analysis of the Dayhoff database (version 35.45 Swis-sProt 35), using a WU-BLAST2 sequence alignment analysis of the full-length sequence shown in FIG. 234 (SEQ ID NO:402), evidenced significant homology between the PRO1801 amino acid sequence and the following Dayhoff sequences: P_W37935, HGS_B477, P_R32277, IL10_

MACFA, P_W46585, P_R39714, P_R71471, P_R10159, IL10_RAT and P_W57201.

Example 121

Isolation of cDNA Clones Encoding Human UCP4

EST databases, which included public EST databases (e.g., GenBank), and a proprietary EST database (LIFESEQ®, Incyte Pharmaceuticals, Palo Alto, Calif.), were searched for sequences having homologies to human UCP3. The search was performed using the computer program BLAST or BLAST2 [Altschul et al., *Methods in Enzymology*, 266:460–480 (1996)] as a comparison of the UCP3 protein sequences to a 6 frame translation of the EST sequences. Those comparisons resulting in a BLAST score of 70 (or in some cases, 90) or greater that did not encode known proteins were clustered and assembled into consensus DNA sequences with the program AssemblIGN and MacVector (Oxford Molecular Group, Inc.).

A DNA sequence ("fromDNA") was assembled relative to other EST sequences using AssemblIGN software. In addition, the fromDNA sequence was extended using repeated cycles of BLAST and AssemblIGN to extend the sequence as far as possible using the sources of EST sequences discussed above. Based on this DNA sequence, oligonucleotides were synthesized to isolate a clone of the full-length coding sequences for UCP4 by PCR. Forward and reverse PCR primers generally range from 20 to 30 nucleotides and are often designed to give a PCR product of about 100–1000 bp in length. The probe sequences are typically 40–55 bp in length. In some cases, additional oligonucleotides are synthesized when the consensus sequence is greater than about 1–1.5 kbp.
PCR primers (forward and reverse) were synthesized:
forward PCR primer CGCGGATCCCGTTATCGTCT-TGCGCTACTGC (SEQ ID NO:407)
reverse PCR primer GCGGAATTCTTAAAATGGACT-GACTCCACTCATC (SEQ ID NO:408)

RNA for construction of the cDNA libraries was isolated from brain tissue. The cDNA libraries used to isolated the cDNA clones were constructed by standard methods using commercially available reagents such as those from Invitrogen, San Diego, Calif. The cDNA was primed with oligo dT containing a NotI site, linked with blunt to SalI hemikinased adaptors, cleaved with NotI, sized appropriately by gel electrophoresis, and cloned in a defined orientation into a suitable cloning vector (such as pRKB or pRKD; pRK5B is a precursor of pRK5D that does not contain the SfiI site; see, Holmes et al., *Science*, 253:1278–1280 (1991)) in the unique XhoI and NotI sites.

DNA sequencing of the clone isolated by PCR as described above gave the full-length DNA sequence for UCP4 (designated herein as DNA77568-1626 [FIG. 235, SEQ ID NO:405] and the derived protein sequence for UCP4.

The entire coding sequence of UCP4 is shown in FIG. 235 (SEQ ID NO:405). Clone DNA77568-1626 contains a single open reading frame with an apparent translational initiation site at nucleotide positions 27–29, and an apparent stop codon at nucleotide positions 996–998. (See FIG. 235; SEQ ID NO:405). The predicted polypeptide precursor is 323 amino acids long. It is presently believed that UCP4 is a membrane-bound protein and contains at least 6 transmembrane regions. These putative transmembrane regions in the UCP4 amino acid sequence are illustrated in FIG. 236. Clone DNA77568-1626, contained in the pcDNA3 vector (Invitrogen) has been deposited with ATCC and is assigned ATCC deposit no. 203134. UCP4 polypeptide is obtained or obtainable by expressing the molecule encoded by the cDNA insert of the deposited ATCC 203134 vector. Digestion of the vector with BamHI and EcoRI restriction enzymes will yield an approximate 972 plus 34 bp insert. The full-length UCP4 protein shown in FIG. 236 has an estimated molecular weight of about 36,061 daltons and a pI of about 9.28.

Example 122

Isolation of cDNA Clones Encoding Human PRO193

A consensus DNA sequence was assembled relative to other EST sequences using phrap as described in Example 1 above. Based on this consensus sequence, oligonucleotides were synthesized: 1) to identify by PCR a cDNA library that contained the sequence of interest, and 2) for use as probes to isolate a clone of the full-length coding sequence for PRO193.

A pair of PCR primers (forward and reverse) were synthesized:
forward PCR primer 5'-GTTTGAGGAAGCTGGGATAC-3' (SEQ ID NO:411); and
reverse PCR primer 5'-CCAAACTCGAGCACCTGTTC-3' (SEQ ID NO:412).
Additionally, a synthetic oligonucleotide hybridization probe was constructed from the consensus sequence which had the following nucleotide sequence:
hybridization probe
5'-ATGGCAGGCTTCCTAGATAATTTTCGTTGGCCA GAATGTG-3' (SEQ ID NO:413).

In order to screen several libraries for a source of a full-length clone, DNA from the libraries was screened by PCR amplification with the PCR primer pair identified above. A positive library was then used to isolate clones encoding the PRO193 gene using the probe oligonucleotide and one of the PCR primers. RNA for construction of the cDNA libraries was isolated from human retina tissue (LIB94).

DNA sequencing of the clones isolated as described above gave the full-length DNA sequence for PRO193 [herein designated as DNA23322-1393] (SEQ ID NO:409) and the derived protein sequence for PRO193.

The entire nucleotide sequence of DNA23322-1393 is shown in FIG. 237 (SEQ ID NO:409). Clone DNA23322-1393 contains a single open reading frame with an apparent translational initiation site at nucleotide positions 138–140 and ending at the stop codon at nucleotide positions 612–614 (FIG. 237). The predicted polypeptide precursor is 158 amino acids long (FIG. 238). The full-length PRO193 protein shown in FIG. 238 has an estimated molecular weight of about 17,936 and a pI of about 5.32. Clone DNA23322-1393 has been deposited with the ATCC. Regarding the sequence, it is understood that the deposited clone contains the correct sequence, and the sequences provided herein are based on known sequencing techniques.

Still analyzing the amino acid sequence of SEQ ID NO:410, transmembrane domains are at about amino acids 23–42, 60–80, 97–117 and 128–148 of SEQ ID NO:410. A cell attachment sequence is at about amino acids 81–83 of SEQ ID NO:410. A peroxidase proximal heme-ligand domain is at about amino acids 81–83 of SEQ ID NO:410. The corresponding nucleotides can be routinely determined given the sequences provided herein.

Example 123

Isolation of cDNA Clones Encoding Human PRO1130

A consensus DNA sequence was assembled relative to other EST sequences using phrap as described in Example 1 above. This consensus sequence is herein designated DNA34360. Based on the DNA34360 consensus sequence, oligonucleotides were synthesized: 1) to identify by PCR a cDNA library that contained the sequence of interest, and 2) for use as probes to isolate a clone of the full-length coding sequence for PRO1130.

PCR primers (forward and reverse) were synthesized:
forward PCR primer (34360.f1)
5'-GCCATAGTCACGACATGGATG-3' (SEQ ID NO:416)
forward PCR primer (34360.f2)
5'-GGATGGCCAGAGCTGCTG-3' (SEQ ID NO:417)
forward PCR primer (34360.f3)
5'-AAAGTACAAGTGTGGCCTCATCAAGC-3' (SEQ ID NO:418)
reverse PCR primer (34360.r1)
5'-TCTGACTCCTAAGTCAGGCAGGAG-3' (SEQ ID NO:419)
reverse PCR primer (34360.r2)
5'-ATTCTCTCCACAGACAGCTGGTTC'3' (SEQ ID NO:420)
Additionally, a synthetic oligonucleotide hybridization probe was constructed from the consensus DNA34360 sequence which had the following nucleotide sequence
hybridization probe (34360.p1)
5'-GTACAAGTGTGGCCTCATCAAGCCCTGCCCAGC CAACTACTTTGCG-3' (SEQ ID NO:421)

In order to screen several libraries for a source of a fill-length clone, DNA from the libraries was screened by PCR amplification with the PCR primer pair identified above. A positive library was then used to isolate clones encoding the PRO1130 gene using the probe oligonucleotide and one of the PCR primers. RNA for construction of the cDNA libraries was isolated from human aortic endothelial cell tissue.

DNA sequencing of the clones isolated as described above gave the full-length DNA sequence for PRO1130 (designated herein as DNA59814-1486 [FIG. 239, SEQ ID NO:414]; and the derived protein sequence for PRO1130.

The entire nucleotide sequence of DNA59814-1486 is shown in FIG. 239 (SEQ ID NO:414). Clone DNA59814-1486 contains a single open reading frame with an apparent translational initiation site at nucleotide positions 312–314 and ending at the stop codon at nucleotide positions 984–986 (FIG. 239). The predicted polypeptide precursor is 224 amino acids long (FIG. 240). The full-length PRO1130 protein shown in FIG. 240 has an estimated molecular weight of about 24,963 daltons and a pI of about 9.64. Analysis of the full-length PRO1130 sequence shown in FIG. 240 (SEQ ID NO:415) evidences the presence of the following: a signal peptide from about amino acid 1 to about amino acid 15, an ATP/GTP-binding site motif A from about amino acid 184 to about amino acid 191 and a potential N-glycosylation site from about amino acid 107 to about amino acid 110. Clone DNA59814-1486 has been deposited with ATCC on Oct. 20, 1998 and is assigned ATCC deposit no. 203359.

An analysis of the Dayhoff database (version 35.45 Swis-sProt 35), using a WU-BLAST2 sequence alignment analysis of the full-length sequence shown in FIG. 240 (SEQ ID NO:415), evidenced significant homology between the PRO1130 amino acid sequence and the following Dayhoff sequences: P_W06547, 216_HUMAN, D871201, MMU726771, LAU048891, and D69319.

Example 124

Isolation of cDNA Clones Encoding Human PRO1335

A consensus DNA sequence was assembled relative to other EST sequences using phrap as described in Example 1 above. This consensus sequence is herein designated DNA35727. Based on the DNA35727 consensus sequence, oligonucleotides were synthesized: 1) to identify by PCR a cDNA library that contained the sequence of interest, and 2) for use as probes to isolate a clone of the full-length coding sequence for PRO1335.

PCR primers (forward and reverse) were synthesized:
forward PCR primer (35727.f1)
5'-GTAAAGTCGCTGGCCAGC-3' (SEQ ID NO:424)
forward PCR primer (35727.f2)
5'-CCCGATCTGCCTGCTGTA-3' (SEQ ID NO:425)
reverse PCR primer (35727.r1)
5'-CTGCACTGTATGGCCATTATTGTG-3' (SEQ ID NO:426)
Additionally, a synthetic oligonucleotide hybridization probe was constructed from the consensus DNA35727 sequence which had the following nucleotide sequence
hybridization probe (35727.p1)
5'-CAGAAACCCATGATACCCTACTGAACACCGAAT CCCCTGGAAGCC-3' (SEQ ID NO:427)

In order to screen several libraries for a source of a full-length clone, DNA from the libraries was screened by PCR amplification with the PCR primer pair identified above. A positive library was then used to isolate clones encoding the PRO1335 gene using the probe oligonucleotide and one of the PCR primers. RNA for construction of the cDNA libraries was isolated from human retina tissue.

DNA sequencing of the clones isolated as described above gave the full-length DNA sequence for PRO1335 (designated herein as DNA62812-1594 [FIG. 241, SEQ ID NO:422]; and the derived protein sequence for PRO1335.

The entire nucleotide sequence of DNA62812-1594 is shown in FIG. 241 (SEQ ID NO:422). Clone DNA62812-1594 contains a single open reading frame with an apparent translational initiation site at nucleotide positions 271–273 and ending at the stop codon at nucleotide positions 1282–1284 (FIG. 241). The predicted polypeptide precursor is 337 amino acids long (FIG. 242). The full-length PRO1335 protein shown in FIG. 242 has an estimated molecular weight of about 37,668 daltons and a pI of about 6.27. Analysis of the full-length PRO1335 sequence shown in FIG. 242 (SEQ ID NO:423) evidences the presence of the following: a signal peptide from about amino acid 1 to about amino acid 15, a transmembrane domain from about amino acid 291 to about amino acid 310, a potential N-glycosylation site from about amino acid 213 to about amino acid 216 and amino acid sequence blocks having homology to eukaryotic-type carbonic anhydrase proteins from about amino acid 197 to about amino acid 245, from about amino acid 104 to about amino acid 140 and from about amino acid 22 to about amino acid 69. Clone DNA62812-1594 has been deposited with ATCC on Sep. 9, 1998 and is assigned ATCC deposit no. 203248.

An analysis of the Dayhoff database (version 35.45 Swis-sProt 35), using a WU-BLAST2 sequence alignment analysis of the full-length sequence shown in FIG. 242 (SEQ ID NO:423), evidenced significant homology between the PRO1335 amino acid sequence and the following Dayhoff sequences: AF037335_1, 138013, PTPG_MOUSE, CAH2_HUMAN, 1CAC, CAH7_HUMAN, CAH3_HUMAN, CAH1_HUMAN, CAH5_HUMAN and P_R41746.

Example 125

Isolation of cDNA Clones Encoding Human PRO1329

Use of the signal sequence algorithm described in Example 3 above allowed identification of an EST cluster sequence from the LIFESEQ® database, designated Incyte Cluster No. 167544, also referred herein as "DNA10680". This EST cluster sequence was then compared to a variety of expressed sequence tag (EST) databases which included public EST databases (e.g., GenBank) and a proprietary EST DNA database (LIFESEQ®, Incyte Pharmaceuticals, Palo Alto, Calif.) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). One or more of the ESTs was derived from a cDNA library constructed from RNA isolated from synovial membrane tissue removed from the elbow of a female with rheumatoid arthritis. The consensus sequence obtained therefrom is herein designated "DNA58836".

In light of the sequence homology between the DNA58836 sequence and a sequence contained within the Incyte EST clone no. 368774, EST clone 368774 was purchased and the cDNA insert was obtained and sequenced. The sequence of this cDNA insert is shown in FIG. 243 and is herein designated as DNA66660-1585.

The full length clone shown in FIG. 243 contained a single open reading frame with an apparent translational initiation site at nucleotide positions 90 to 92 and ending at the stop codon found at nucleotide positions 717 to 719 (FIG. 243; SEQ ID NO:428). The predicted polypeptide precursor (FIG. 244, SEQ ID NO:429) is 209 amino acids long, with a signal sequence at about amino acids 1–16. PRO1329 has a calculated molecular weight of approximately 21,588 daltons and an estimated pI of approximately 5.50. Clone DNA66660-1585 was deposited with the ATCC on Sep. 22, 1998 and is assigned ATCC deposit no. 203279.

An analysis of the Dayhoff database (version 35.45 SwissProt 35), using a WU-BLAST2 sequence alignment analysis of the full-length sequence shown in FIG. 244 (SEQ ID NO:429), revealed some homology between the PRO1329 amino acid sequence and the following Dayhoff sequences: CELK06A9_3, PROA_XANCP, CXU21300_4, MTV037_17, SYN1_RAT, I56542, S60743, BNOLE3_1, AB001573_1, and P_P80671.

Example 126

Isolation of cDNA Clones Encoding Human PRO1550

Use of the signal sequence algorithm described in Example 3 above allowed identification of an EST sequence from the Merck database, designated CELT15B7_12, also referred herein as "DNA10022". This EST sequence was then compared to a variety of expressed sequence tag (EST) databases which included public and proprietary EST databases (e.g., GenBank and LIFESEQ®) to identify existing homologies. The homology search was performed using the computer program BLAST or BLAST2 (Altshul et al., Methods in Enzymology 266:460–480 (1996)). Those comparisons resulting in a BLAST score of 70 (or in some cases 90) or greater that did not encode known proteins were clustered and assembled into a consensus DNA sequence with the program "phrap" (Phil Green, University of Washington, Seattle, Wash.). The consensus sequence obtained therefrom is herein designated "DNA55708".

In light of the sequence homology between the DNA55708 sequence and a sequence contained within Incyte EST no. 3411659, the EST clone 3411659 was purchased and the cDNA insert was obtained and sequenced in its entirety. The sequence of this cDNA insert is shown in FIG. 245 and is herein designated as "DNA76393-1664".

The full length clone shown in FIG. 245 contained a single open reading frame with an apparent translational initiation site at nucleotide positions 138 to 140 and ending at the stop codon found at nucleotide positions 867 to 869 (FIG. 245; SEQ ID NO:430). The predicted polypeptide precursor (FIG. 246, SEQ ID NO:431) is 243 amino acids long. Other features of the PRO1550 protein include: a signal sequence at about amino acids 1–30; a hydrophobic domain at about amino acids 195–217; and a potential N-glycosylation site at about amino acids 186–189. PRO1550 has a calculated molecular weight of approximately 26,266 daltons and an estimated pI of approximately 8.43. Clone DNA76393-1664 was deposited with the ATCC on Oct. 6, 1998, and is assigned ATCC deposit no. 203323.

An analysis of the Dayhoff database (version 35.45 SwissProt 35), using a WU-BLAST2 sequence alignment analysis of the full-length sequence shown in FIG. 246 (SEQ ID NO:431), revealed some homology between the PRO1550 amino acid sequence and the following Dayhoff sequences: CELF59E12_11; CA24_ASCSU; AF018082_1; CA13_BOVIN; CA54_HUMAN; CA34_HUMAN; HUMCOL7A1X_11; P_W09643; AF053538_1; and HSEMCXIV2_1.

Example 127

Use of PRO as a Hybridization Probe

The following method describes use of a nucleotide sequence encoding PRO as a hybridization probe.

DNA comprising the coding sequence of full-length or mature PRO as disclosed herein is employed as a probe to screen for homologous DNAs (such as those encoding naturally-occurring variants of PRO) in human tissue cDNA libraries or human tissue genomic libraries.

Hybridization and washing of filters containing either library DNAs is performed under the following high stringency conditions. Hybridization of radiolabeled PRO-derived probe to the filters is performed in a solution of 50% formamide, 5× SSC, 0.1% SDS, 0.1% sodium pyrophosphate, 50 mM sodium phosphate, pH 6.8, 2× Denhardt's solution, and 10% dextran sulfate at 42° C. for 20 hours. Washing of the filters is performed in an aqueous solution of 0.1×SSC and 0.1% SDS at 42° C.

DNAs having a desired sequence identity with the DNA encoding full-length native sequence PRO can then be identified using standard techniques known in the art.

Example 128

Expression of PRO in E. coli

This example illustrates preparation of an unglycosylated form of PRO by recombinant expression in E. coli.

The DNA sequence encoding PRO is initially amplified using selected PCR primers. The primers should contain restriction enzyme sites which correspond to the restriction enzyme sites on the selected expression vector. A variety of expression vectors may be employed. An example of a suitable vector is pBR322 (derived from E. coli; see Bolivar et al., Gene, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the PRO coding region, lambda transcriptional terminator, and an argU gene.

The ligation mixture is then used to transform a selected E. coli strain using the methods described in Sambrook et al., supra. Transformants are identified by their ability to grow on LB plates and antibiotic resistant colonies are then selected. Plasmid DNA can be isolated and confimed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized PRO protein can then be purified using a metal chelating column under conditions that allow tight binding of the protein.

PRO may be expressed in E. coli in a poly-His tagged form, using the following procedure. The DNA encoding PRO is initially amplified using selected PCR primers. The primers will contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences are then ligated into an expression vector, which is used to transform an E. coli host based on strain 52 (W3110 fuhA(tonA) lon galE rpoHts(htpRts) clpP(lacIq). Transformants are first grown in LB containing 50 mg/ml carbenicillin at 30° C. with shaking until an O.D.600 of 3–5 is reached. Cultures are then diluted 50–100 fold into CRAP media (prepared by mixing 3.57 g $(NH_4)_2SO_4$, 0.71 g sodium citrate.2H2O, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20–30 hours at 30° C. with shaking. Samples are removed to verify expression by SDS-PAGE analysis, and the bulk culture is centrifuged to pellet the cells. Cell pellets are frozen until purification and refolding.

E. coli paste from 0.5 to 1 L fermentations (6–10 g pellets) is resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution is stirred overnight at 4° C. This step results in a denatured protein with all cysteine residues blocked by sulfitolization. The solution is centrifuged at 40,000 rpm in a Beckman Ultracentifuge for 30 min. The supernatant is diluted with 3–5 volumes of metal chelate column buffer (6 M guanidine, 20 mM Tris, pH 7.4) and filtered through 0.22 micron filters to clarify. The clarified extract is loaded onto a 5 ml Qiagen Ni-NTA metal chelate column equilibrated in the metal chelate column buffer. The column is washed with additional buffer containing 50 mM imidazole (Calbiochem, Utrol grade), pH 7.4. The protein is eluted with buffer containing 250 mM imidazole. Fractions containing the desired protein are pooled and stored at 4° C. Protein concentration is estimated by its absorbance at 280 μm using the calculated extinction coefficient based on its amino acid sequence.

The proteins are refolded by diluting the sample slowly into freshly prepared refolding buffer consisting of: 20 mM Tris, pH 8.6, 0.3 M NaCl, 2.5 M urea, 5 mM cysteine, 20 mM glycine and 1 mM EDTA. Refolding volumes are chosen so that the final protein concentration is between 50 to 100 micrograms/min. The refolding solution is stirred gently at 4° C. for 12–36 hours. The refolding reaction is quenched by the addition of TFA to a final concentration of 0.4% (pH of approximately 3). Before further purification of the protein, the solution is filtered through a 0.22 micron filter and acetonitrile is added to 2–10% final concentration. The refolded protein is chromatographed on a Poros R1/H reversed phase column using a mobile buffer of 0.1% TFA with elution with a gradient of acetonitrile from 10 to 80%. Aliquots of fractions with A280 absorbance are analyzed on SDS polyacrylamide gels and fractions containing homogeneous refolded protein are pooled. Generally, the properly refolded species of most proteins are eluted at the lowest concentrations of acetonitrile since those species are the most compact with their hydrophobic interiors shielded from interaction with the reversed phase resin. Aggregated species are usually eluted at higher acetonitrile concentrations. In addition to resolving misfolded forms of proteins from the desired form, the reversed phase step also removes endotoxin from the samples.

Fractions containing the desired folded PRO polypeptide are pooled and the acetonitrile removed using a gentle stream of nitrogen directed at the solution. Proteins are formulated in 20 mM Hepes, pH 6.8 with 0.14 M sodium chloride and 4% mannitol by dialysis or by gel filtration using G25 Superfine (Pharmacia) resins equilibrated in the formulation buffer and sterile filtered.

Many of the PRO polypeptides disclosed herein were successfully expressed as described above.

Example 129

Expression of PRO in Mammalian Cells

This example illustrates preparation of a potentially glycosylated form of PRO by recombinant expression in mammalian cells.

The vector, pRK5 (see EP 307,247, published Mar. 15, 1989), is employed as the expression vector. Optionally, the PRO DNA is ligated into pRK5 with selected restriction enzymes to allow insertion of the PRO DNA using ligation methods such as described in Sambrook et al., supra. The resulting vector is called pRK5-PRO.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg pRK5-PRO DNA is mixed with about 1 μg DNA encoding the VA RNA gene [Thimmappaya et al., Cell, 31:543 (1982)] and dissolved in 500 μl of 1 mM Tris-HCl, 0.1 mM EDTA, 0.227 M $CaCl_2$. To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 µCi/ml $^{35}$S-cysteine and 200 µCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of PRO polypeptide. The cultures containing transfected cells may undergo further incubation (in serum free medium) and the medium is tested in selected bioassays.

In an alternative technique, PRO may be introduced into 293 cells transiently using the dextran sulfate method described by Somparyrac et al., *Proc. Natl. Acad. Sci.*, 12:7575 (1981). 293 cells are grown to maximal density in a spinner flask and 700 µg pRK5-PRO DNA is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 µg/ml bovine insulin and 0.1 µg/ml bovine transferrin. After about four days, the conditioned media is centrifuged and filtered to remove cells and debris. The sample containing expressed PRO can then be concentrated and purified by any selected method, such as dialysis and/or column chromatography.

In another embodiment, PRO can be expressed in CHO cells. The pRK5-PRO can be transfected into CHO cells using known reagents such as $CAPO_4$ or DEAE-dextran. As described above, the cell cultures can be incubated, and the medium replaced with culture medium (alone) or medium containing a radiolabel such as $^{35}$S-methionine. After determining the presence of PRO polypeptide, the culture medium may be replaced with serum free medium. Preferably, the cultures are incubated for about 6 days, and then the conditioned medium is harvested. The medium containing the expressed PRO can then be concentrated and purified by any selected method.

Epitope-tagged PRO may also be expressed in host CHO cells. The PRO may be subcloned out of the pRK5 vector. The subclone insert can undergo PCR to fuse in frame with a selected epitope tag such as a poly-his tag into a Baculovirus expression vector. The poly-his tagged PRO insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged PRO can then be concentrated and purified by any selected method, such as by $Ni^{2+}$-chelate affinity chromatography.

PRO may also be expressed in CHO and/or COS cells by a transient expression procedure or in CHO cells by another stable expression procedure.

Stable expression in CHO cells is performed using the following procedure. The proteins are expressed as an IgG construct (immunoadhesin), in which the coding sequences for the soluble forms (e.g. extracellular domains) of the respective proteins are fused to an IgG1 constant region sequence containing the hinge, CH2 and CH2 domains and/or is a poly-His tagged form.

Following PCR amplification, the respective DNAs are subcloned in a CHO expression vector using standard techniques as described in Ausubel et al., *Current Protocols of Molecular Biology*, Unit 3.16, John Wiley and Sons (1997). CHO expression vectors are constructed to have compatible restriction sites 5' and 3' of the DNA of interest to allow the convenient shuttling of cDNA's. The vector used expression in CHO cells is as described in Lucas et al., *Nucl. Acids Res.* 24:9 (1774–1779 (1996), and uses the SV40 early promoter/enhancer to drive expression of the cDNA of interest and dihydrofolate reductase (DHFR). DHFR expression permits selection for stable maintenance of the plasmid following transfection.

Twelve micrograms of the desired plasmid DNA is introduced into approximately 10 million CHO cells using commercially available transfection reagents Superfect® (Quiagen), Dosper® or Fugene® (Boehringer Mannheim). The cells are grown as described in Lucas et al., supra. Approximately $3 \times 10^{-7}$ cells are frozen in an ampule for further growth and production as described below.

The ampules containing the plasmid DNA are thawed by placement into water bath and mixed by vortexing. The contents are pipetted into a centrifuge tube containing 10 mLs of media and centrifuged at 1000 rpm for 5 minutes. The supernatant is aspirated and the cells are resuspended in 10 mL of selective media (0.2 µm filtered PS20 with 5% 0.2 µm diafiltered fetal bovine serum). The cells are then aliquoted into a 100 mL spinner containing 90 mL of selective media. After 1–2 days, the cells are transferred into a 250 mL spinner filled with 150 mL selective growth medium and incubated at 37° C. After another 2–3 days, 250 mL, 500 mL and 2000 mL spinners are seeded with $3 \times 10^5$ cells/mL. The cell media is exchanged with fresh media by centrifugation and resuspension in production medium. Although any suitable CHO media may be employed, a production medium described in U.S. Pat. No. 5,122,469, issued Jun. 16, 1992 may actually be used. A 3L production spinner is seeded at $1.2 \times 10^6$ cells/mL. On day 0, the cell number pH ie determined. On day 1, the spinner is sampled and sparging with filtered air is commenced. On day 2, the spinner is sampled, the temperature shifted to 33° C., and 30 mL of 500 g/L glucose and 0.6 mL of 10% antifoam (e.g., 35% polydimethylsiloxane emulsion, Dow Corning 365 Medical Grade Emulsion) taken. Throughout the production, the pH is adjusted as necessary to keep it at around 7.2. After 10 days, or until the viability dropped below 70%, the cell culture is harvested by centrifugation and filtering through a 0.22 µm filter. The filtrate was either stored at 4° C. or immediately loaded onto columns for purification.

For the poly-His tagged constructs, the proteins are purified using a Ni-NTA column (Qiagen). Before purification, imidazole is added to the conditioned media to a concentration of 5 mM. The conditioned media is pumped onto a 6 ml Ni-NTA column equilibrated in 20 mM Hepes, pH 7.4, buffer containing 0.3 M NaCl and 5 mM imidazole at a flow rate of 4–5 ml/min. at 4° C. After loading, the column is washed with additional equilibration buffer and the protein eluted with equilibration buffer containing 0.25 M imidazole. The highly purified protein is subsequently desalted into a storage buffer containing 10 mM Hepes, 0.14 M NaCl and 4% mannitol, pH 6.8, with a 25 ml G25 Superfine (Pharmacia) column and stored at −80° C. Immunoadhesin (Fc-containing) constructs are purified from the conditioned media as follows. The conditioned medium is pumped onto a 5 ml Protein A column (Pharmacia) which had been equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 µL of 1 M Tris buffer, pH 9. The highly purified protein is subsequently desalted into storage buffer as described above for the poly-His tagged proteins. The homogeneity is assessed by SDS polyacrylamide gels and by N-terminal amino acid sequencing by Edman degradation.

Many of the PRO polypeptides disclosed herein were successfully expressed as described above.

Example 130

Expression of PRO in Yeast

The following method describes recombinant expression of PRO in yeast.

First, yeast expression vectors are constructed for intracellular production or secretion of PRO from the ADH2/GAPDH promoter. DNA encoding PRO and the promoter is inserted into suitable restriction enzyme sites in the selected plasmid to direct intracellular expression of PRO. For secretion, DNA encoding PRO can be cloned into the selected plasmid, together with DNA encoding the ADH2/GAPDH promoter, a native PRO signal peptide or other mammalian signal peptide, or, for example, a yeast alpha-factor or invertase secretory signal/leader sequence, and linker sequences (if needed) for expression of PRO.

Yeast cells, such as yeast strain AB110, can thenbe transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant PRO can subsequently be isolated and purified by removing the yeast cells from the fermentation medium by centrifugation and then concentrating the medium using selected cartridge filters. The concentrate containing PRO may further be purified using selected column chromatography resins.

Many of the PRO polypeptides disclosed herein were successfully expressed as described above.

Example 131

Expression of PRO in Baculovirus-Infected Insect Cells

The following method describes recombinant expression of PRO in Baculovirus-infected insect cells.

The sequence coding for PRO is fused upstream of an epitope tag contained within a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the sequence encoding PRO or the desired portion of the coding sequence of PRO such as the sequence encoding the extracellular domain of a transmembrane protein or the sequence encoding the mature protein if the protein is extracellular is amplified by PCR with primers complementary to the 5' and 3' regions. The 5'primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into Spodopterafrugiperda ("Sf9") cells (ATCC CRL 1711) using lipofectin (commercially available from GIBCO-BRL). After 4–5 days of incubation at 28° C., the released viruses are harvested and used for further amplifications. Viral infection and protein expression are performed as described by O'Reilley et al., *Baculovirus expression vectors: A Laboratory Manual*, Oxford: Oxford University Press (1994).

Expressed poly-his tagged PRO can then be purified, for example, by $Ni^{2+}$-chelate affinity chromatography as follows. Extracts are prepared from recombinant virus-infected Sf9 cells as described by Rupert et al., *Nature*, 362:175–179 (1993). Briefly, Sf9 cells are washed, resuspended in sonication buffer (25 mL Hepes, pH 7.9; 12.5 mM $MgCl_2$; 0.1 mM EDTA; 10% glycerol; 0.1% NP-40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% glycerol, pH 7.8) and filtered through a 0.45 µm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% glycerol, pH 6.0), which elutes nonspecifically bound protein. After reaching $A_{280}$ baseline again, the column is developed with a 0 to 500 nM Imidazole gradient in the secondary wash buffer. One mL fractions are collected and analyzed by SDS-PAGE and silver staining or Western blot with $Ni^{2+}$-NTA-conjugated to alkaline phosphatase (Qiagen). Fractions containing the eluted $His_{10}$-tagged PRO are pooled and dialyzed against loading buffer.

Alternatively, purification of the IgG tagged (or Fc tagged) PRO can be performed using known chromatography techniques, including for instance, Protein A or protein G column chromatography.

Many of the PRO polypeptides disclosed herein were successfully expressed as described above.

Example 132

Preparation of Antibodies that Bind PRO

This example illustrates preparation of monoclonal antibodies which can specifically bind PRO.

Techniques for producing the monoclonal antibodies are known in the art and are described, for instance, in Goding, supra. Immunogens that may be employed include purified PRO, fusion proteins containing PRO, and cells expressing recombinant PRO on the cell surface. Selection of the immunogen can be made by the skilled artisan without undue experimentation.

Mice, such as Balb/c, are immunized with the PRO immunogen emulsified in complete Freund's adjuvant and injected subcutaneously or intraperitoneally in an amount from 1–100 micrograms. Alternatively, the immunogen is emulsified in MPL-TDM adjuvant (Ribi Immunochemical Research, Hamilton, Mont.) and injected into the animal's hind foot pads. The immunized mice are then boosted 10 to 12 days later with additional immunogen emulsified in the selected adjuvant. Thereafter, for several weeks, the mice may also be boosted with additional immunization injections. Serum samples may be periodically obtained from the mice by retro-orbital bleeding for testing in ELISA assays to detect anti-PRO antibodies.

After a suitable antibody titer has been detected, the animals "positive" for antibodies can be injected with a final intravenous injection of PRO. Three to four days later, the mice are sacrificed and the spleen cells are harvested. The spleen cells are then fused (using 35% polyethylene glycol) to a selected murine myeloma cell line such as P3X63AgU.1, available from ATCC, No. CRL 1597. The fusions generate hybridoma cells which can then be plated in 96 well tissue culture plates containing HAT (hypoxanthine, aminopterin, and thymidine) medium to inhibit proliferation of non-fused cells, myeloma hybrids, and spleen cell hybrids.

The hybridoma cells will be screened in an ELISA for reactivity against PRO. Determination of "positive" hybridoma cells secreting the desired monoclonal antibodies against PRO is within the skill in the art.

The positive hybridoma cells can be injected intraperitoneally into syngeneic Balb/c mice to produce ascites containing the anti-PRO monoclonal antibodies. Alternatively, the hybridoma cells can be grown in tissue culture flasks or roller bottles. Purification of the monoclonal antibodies produced in the ascites can be accomplished using ammonium sulfate precipitation, followed by gel exclusion chromatography. Alternatively, affinity chromatography based upon binding of antibody to protein A or protein G can be employed.

Example 133

Purification of PRO Polypeptides Using Scientific Antibodies

Native or recombinant PRO polypeptides may be purified by a variety of standard techniques in the art of protein purification. For example, pro-PRO polypeptide, mature PRO polypeptide, or pre-PRO polypeptide is purified by immunoaffinity chromatography using antibodies specific for the PRO polypeptide of interest. In general, an immunoaffinity column is constructed by covalently coupling the anti-PRO polypeptide antibody to an activated chromatographic resin.

Polyclonal immunoglobulins are prepared from immune sera either by precipitation with ammonium sulfate or by purification on immobilized Protein A (Pharmacia LKB Biotechnology, Piscataway, N.J.). Likewise, monoclonal antibodies are prepared from mouse ascites fluid by ammonium sulfate precipitation or chromatography on immobilized Protein A. Partially purified immunoglobulin is covalently attached to a chromatographic resin such as CnBr-activated SEPHAROSE™ (Pharmacia LKB Biotechnology). The antibody is coupled to the resin, the resin is blocked, and the derivative resin is washed according to the manufacturer's instructions.

Such an immunoaffinity column is utilized in the purification of PRO polypeptide by preparing a fraction from cells containing PRO polypeptide in a soluble form. This preparation is derived by solubilization of the whole cell or of a subcellular fraction obtained via differential centrifugation by the addition of detergent or by other methods well known in the art. Alternatively, soluble PRO polypeptide containing a signal sequence may be secreted in useful quantity into the medium in which the cells are grown.

A soluble PRO polypeptide-containing preparation is passed over the immunoaffinity column, and the column is washed under conditions that allow the preferential absorbance of PRO polypeptide (e.g., high ionic strength buffers in the presence of detergent). Then, the column is eluted under conditions that disrupt antibody/PRO polypeptide binding (e.g., a low pH buffer such as approximately pH 2–3, or a high concentration of a chaotrope such as urea or thiocyanate ion), and PRO polypeptide is collected.

Example 134

Drug Screening

This invention is particularly useful for screening compounds by using PRO polypeptides or binding fragment thereof in any of a variety of drug screening techniques. The PRO polypeptide or fragment employed in such a test may either be free in solution, affixed to a solid support, borne on a cell surface, or located intracellularly. One method of drug screening utilizes eukaryotic or prokaryotic host cells which are stably transformed with recombinant nucleic acids expressing the PRO polypeptide or fragment. Drugs are screened against such transformed cells in competitive binding assays. Such cells, either in viable or fixed form, can be used for standard binding assays. One may measure, for example, the formation of complexes between PRO polypeptide or a fragment and the agent being tested. Alternatively, one can examine the diminution in complex formation between the PRO polypeptide and its target cell or target receptors caused by the agent being tested.

Thus, the present invention provides methods of screening for drugs or any other agents which can affect a PRO polypeptide-associated disease or disorder. These methods comprise contacting such an agent with an PRO polypeptide or fragment thereof and assaying (I) for the presence of a complex between the agent and the PRO polypeptide or fragment, or (ii) for the presence of a complex between the PRO polypeptide or fragment and the cell, by methods well known in the art. In such competitive binding assays, the PRO polypeptide or fragment is typically labeled. After suitable incubation, free PRO polypeptide or fragment is separated from that present in bound form, and the amount of free or uncomplexed label is a measure of the ability of the particular agent to bind to PRO polypeptide or to interfere with the PRO polypeptide/cell complex.

Another technique for drug screening provides high throughput screening for compounds having suitable binding affinity to a polypeptide and is described in detail in WO 84/03564, published on Sep. 13, 1984. Briefly stated, large numbers of different small peptide test compounds are synthesized on a solid substrate, such as plastic pins or some other surface. As applied to a PRO polypeptide, the peptide test compounds are reacted with PRO polypeptide and washed. Bound PRO polypeptide is detected by methods well known in the art. Purified PRO polypeptide can also be coated directly onto plates for use in the aforementioned drug screening techniques. In addition, non-neutralizing antibodies can be used to capture the peptide and immobilize it on the solid support.

This invention also contemplates the use of competitive drug screening assays in which neutralizing antibodies capable of binding PRO polypeptide specifically compete with a test compound for binding to PRO polypeptide or fragments thereof. In this manner, the antibodies can be used to detect the presence of any peptide which shares one or more antigenic determinants with PRO polypeptide.

Example 135

Rational Drug Design

The goal of rational drug design is to produce structural analogs of biologically active polypeptide of interest (i.e., a PRO polypeptide) or of small molecules with which they interact, e.g., agonists, antagonists, or inhibitors. Any of these examples can be used to fashion drugs which are more active or stable forms of the PRO polypeptide or which enhance or interfere with the function of the PRO polypeptide in vivo (cf., Hodgson, *Bio/Technology*, 2: 19–21(1991)).

In one approach, the three-dimensional structure of the PRO polypeptide, or of an PRO polypeptide-inhibitor complex, is determined by x-ray crystallography, by computer modeling or, most typically, by a combination of the two approaches. Both the shape and charges of the PRO polypeptide must be ascertained to elucidate the structure and to determine active site(s) of the molecule. Less often, useful information regarding the structure of the PRO polypeptide may be gained by modeling based on the structure of homologous proteins. In both cases, relevant structural information is used to design analogous PRO polypeptide-like molecules or to identify efficient inhibitors. Useful examples of rational drug design may include molecules which have improved activity or stability as shown by Braxton and Wells, *Biochemistry* 31:7796–7801 (1992) or which act as inhibitors, agonists, or antagonists of native peptides as shown by Athauda et al., *J. Biochem.*, 113:742–746 (1993).

It is also possible to isolate a target-specific antibody, selected by functional assay, as described above, and then to solve its crystal structure. This approach, in principle, yields a pharmacore upon which subsequent drug design can be based. It is possible to bypass protein crystallography altogether by generating anti-idiotypic antibodies (anti-ids) to a functional, pharmacologically active antibody. As a mirror image of a mirror image, the binding site of the anti-ids would be expected to be an analog of the original receptor. The anti-id could then be used to identify and isolate peptides from banks of chemically or biologically produced peptides. The isolated peptides would then act as the pharmacore.

By virtue of the present invention, sufficient amounts of the PRO polypeptide may be made available to perform such analytical studies as X-ray crystallography. In addition, knowledge of the PRO polypeptide amino acid sequence provided herein will provide guidance to those employing computer modeling techniques in place of or in addition to x-ray crystallography.

Example 136

Stimulation of Endothelial Cell Proliferation (Assay 8)

This assay is designed to determine whether PRO polypeptides of the present invention show the ability to stimulate adrenal cortical capillary endothelial cell (ACE) growth. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Bovine adrenal cortical capillary endothelial (ACE) cells (from primary culture, maximum of 12–14 passages) were plated in 96-well plates at 500 cells/well per 100 microliter. Assay media included low glucose DMEM, 10% calf serum, 2 mM glutamine, and 1× penicillin/streptomycin/fungizone. Control wells included the following: (1) no ACE cells added; (2) ACE cells alone; (3) ACE cells plus VEGF (5 ng/ml); and (4) ACE cells plus FGF (5 ng/ml). The control or test sample, (in 100 microliter volumes), was then added to the wells (at dilutions of 1%, 0.1% and 0.01%, respectively). The cell cultures were incubated for 6–7 days at 37° C./5% $CO_2$. After the incubation, the media in the wells was aspirated, and the cells were washed 1× with PBS. An acid phosphatase reaction mixture (100 microliter; 0.1M sodium acetate, pH 5.5, 0.1% Triton X-100, 10 mM p-nitrophenyl phosphate) was then added to each well. After a 2 hour incubation at 37° C., the reaction was stopped by addition of 10 microliters IN NaOH. Optical density (OD) was measured on a microplate reader at 405 nm.

The activity of a PRO polypeptide was calculated as the fold increase in proliferation (as determined by the acid phosphatase activity, OD 405 nm) relative to (1) cell only background, and (2) relative to maximum stimulation by VEGF. VEGF (at 3–10 ng/ml) and FGF (at 1–5 ng/ml) were employed as an activity reference for maximum stimulation. Results of the assay were considered "positive" if the observed stimulation was >50% increase over background. VEGF (5 ng/ml) control at 1% dilution gave 1.24 fold stimulation; FGF (5 ng/ml) control at 1% dilution gave 1.46 fold stimulation.

The following PRO polypeptides tested positive in this assay: PRO1244, PRO1286 and PRO1303.

Example 137

Inhibitory Activity in Mixed Lymphocyte Reaction (MLR) Assay (Assay 67)

This example shows that one or more of the polypeptides of the invention are active as inhibitors of the proliferation of stimulated T-lymphocytes. Compounds which inhibit proliferation of lymphocytes are useful therapeutically where suppression of an immune response is beneficial.

The basic protocol for this assay is described in Current Protocols in Immunology, unit 3.12; edited by J E Coligan, A M Kruisbeek, D H Marglies, E M Shevach, W Strober, National Insitutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3\times10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:

100:1 of test sample diluted to 1% or to 0.1%,
50:1 of irradiated stimulator cells, and
50:1 of responder PBMC cells.

100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/ streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1 \times 10^7$ cells/ml of assay media. The assay is then conducted as described above.

Any decreases below control is considered to be a positive result for an inhibitory compound, with decreases of less than or equal to 80% being preferred. However, any value less than control indicates an inhibitory effect for the test protein.

The following polypeptide tested positive in this assay: PRO1250, PRO1418 and PRO1410.

Example 138

Stimulation of Heart Neonatal Hypertrophy (Assay 1)

This assay is designed to measure the ability of PRO polypeptides to stimulate hypertrophy of neonatal heart. PRO polypeptides testing positive in this assay would be expected to be useful for the therapeutic treatment of various cardiac insufficiency disorders.

Cardiac myocytes from 1-day old Harlan Sprague Dawley rats were obtained. Cells (180 μl at $7.5 \times 10^4$/ml, serum <0.1%, freshly isolated) are added on day 1 to 96-well plates previously coated with DMEM/F12+4% FCS. Test samples containing the test PRO polypeptide are added directly to wells on day 2 in 20 μL volumes. Cells are stained with crystal violet after an additional two days and scored visually by the next day. Incubator conditions require 5% $CO_2$.

Activity reference: phenylephrine at 1–100 μM, PGF-2 alpha at 0.1–1.0 MM, endothelin-1 at 1–10 nM, CT1 (LIF) at 1–10 nM. No PBS is included, since calcium concentration is critical for assay response. Assay media included: DMEM/F12 (with 2.44 gm bicarbonate), 10 μg/ml transferrin, 1 μg/ml insulin, 1 μg/ml aprotinin, 2 mmol/L glutamine, 100 U/ml penicillin G, 100 μg/ml streptomycin. Protein buffer containing mannitol (4%) gave a positive signal (score 3.5) at 1/10 (0.4%) and 1/100 (0.04%), but not at 1/1000 (0.004%). Therefore, the test sample buffer containing mannitol is not run. A secondary assay consists of measuring the ANP levels (ng/ml) by ELISA in conditioned media from the cells. An increase in the ANP message can be measured by PCR from cells after a few hours.

Results are assessed by visually observing cell size: a score=3.5 or greater is considered positive for conditioned media; a score of 3.0 or greater is considered positive for purified protein.

The following purified PRO polypeptide was observed to stimulate neonatal heart hypertrophy in this assay: PRO1246.

Example 139

Inhibition of Vascular Endothelial Growth Factor (VEGF) Stimulated Proliferation of Endothelial Cell Growth (Assay 9)

The ability of various PRO polypeptides to inhibit VEGF stimulated proliferation of endothelial cells was tested. Polypeptides testing positive in this assay are useful for inhibiting endothelial cell growth in mammals where such an effect would be beneficial, e.g., for inhibiting tumor growth.

Specifically, bovine adrenal cortical capillary endothelial cells (ACE) (from primary culture, maximum of 12–14 passages) were plated in 96-well plates at 500 cells/well per 100 microliter. Assay media included low glucose DMEM, 10% calf serum, 2 mM glutamine, and 1X penicillin/streptomycin/fungizone. Control wells included the following: (1) no ACE cells added; (2) ACE cells alone; (3) ACE cells plus 5 ng/ml FGF; (4) ACE cells plus 3 ng/ml VEGF; (5) ACE cells plus 3 ng/ml VEGF plus 1 ng/ml TGF-beta; and (6) ACE cells plus 3 ng/ml VEGF plus 5 ng/ml LIF. The test samples, poly-his tagged PRO polypeptides (in 100 microliter volumes), were then added to the wells (at dilutions of 1%, 0.1% and 0.01%, respectively). The cell cultures were incubated for 6–7 days at 37° C./5% $CO_2$. After the incubation, the media in the wells was aspirated, and the cells were washed 1× with PBS. An acid phosphatase reaction mixture (100 microliter; 0.1M sodium acetate, pH 5.5, 0.1% Triton X-100, 10 mM p-nitrophenyl phosphate) was then added to each well. After a 2 hour incubation at 37° C., the reaction was stopped by addition of 10 microliters 1N NaOH. Optical density (OD) was measured on a microplate reader at 405 nm.

The activity of PRO polypeptides was calculated as the percent inhibition of VEGF (3 ng/ml) stimulated proliferation (as determined by measuring acid phosphatase activity at OD 405 nm) relative to the cells without stimulation. TGF-beta was employed as an activity reference at 1 ng/ml, since TGF-beta blocks 70–90% of VEGF-stimulated ACE cell proliferation. The results are indicative of the utility of the PRO polypeptides in cancer therapy and specifically in inhibiting tumor angiogenesis. Numerical values (relative inhibition) are determined by calculating the percent inhibition of VEGF stimulated proliferation by the PRO polypeptides relative to cells without stimulation and then dividing that percentage into the percent inhibition obtained by TGF-β at 1 ng/ml which is known to block 70–90% of VEGF stimulated cell proliferation. The results are considered positive if the PRO polypeptide exhibits 30% or greater inhibition of VEGF stimulation of endothelial cell growth (relative inhibition 30% or greater).

The following polypeptide tested positive in this assay: PRO1246.

Example 140

Human Venous Endothelial Cell Calcium Flux Assay (Assay 68)

This assay is designed to determine whether PRO polypeptides show the ability to stimulate calcium flux in human umbilical vein endothelial cells (HUVEC, Cell Systems). Calcium influx is a well documented response upon binding of certain ligands to their receptors. A test compound that results in a positive response in the present calcium influx assay can be said to bind to a specific receptor and activate a biological signaling pathway in human endothelial cells. This will ultimately lead, for example, to cell division, inhibition of cell proliferation, endothelial tube formation, cell migration, apoptosis, etc.

Human venous umbilical vein endothelial cells (HUVEC, Cell Systems) in growth media (50:50 without glycine, 1% glutamine, 10 M Hepes, 10% FBS, 10 ng/ml bFGF), were plated on 96-well microtiter ViewPlates-96 (Packard Instrument Company Part #6005182) microtiter plates at a cell density of $2 \times 10^4$ cells/well. The day after plating, the cells were washed three times with buffer (HBSS plus 10 mM Hepes), leaving 100 μl/well. Then 100 μl/well of 8 μM Fluo-3 (2×) was added. The cells were incubated for 1.5 hours at 37° C./5% $CO_2$. After incubation, the cells were then washed 3× with buffer (described above) leaving 100 µl/well. Test samples of the PRO polypeptides were prepared on different 96-well plates at 5× concentration in buffer. The positive control corresponded to 50 µM ionomycin (5×); the negative control corresponded to Protein 32. Cell plate and sample plates were run on a FLIPR (Molecular Devices) machine. The FLIPR machine added 25 µl of test sample to the cells, and readings were taken every second for one minute, then every 3 seconds for the next three minutes.

The fluorescence change from baseline to the maximum rise of the curve (Δchange) was calculated, and replicates averaged. The rate of fluorescence increase was monitored, and only those samples which had a Δ change greater than 1000 and a rise within 60 seconds, were considered positive.

The following PRO polypeptides tested positive in this assay: PRO1246 and PRO1561.

Example 141

Skin Vascular Permeability Assay (Assay 64)

This assay shows that certain polypeptides of the invention stimulate an immune response and induce inflammation by inducing mononuclear cell, eosinophil and PMN infiltration at the site of injection of the animal. Compounds which stimulate an immune response are useful therapeutically where stimulation of an immune response is beneficial. This skin vascular permeability assay is conducted as follows. Hairless guinea pigs weighing 350 grams or more are anesthetized with ketamine (75–80 mg/Kg) and 5 mg/Kg xylazine intramuscularly (IM). A sample of purified polypeptide of the invention or a conditioned media test sample is injected intradermally onto the backs of the test animals with 100 µl per injection site. It is possible to have about 10–30, preferably about 16–24, injection sites per animal. One µl of Evans blue dye (1% in physiologic buffered saline) is injected intracardially. Blemishes at the injection sites are then measured (mm diameter) at 1 hr and 6 hr post injection. Animals were sacrificed at 6 hrs after injection. Each skin injection site is biopsied and fixed in formalin. The skins are then prepared for histopathologic evaluation. Each site is evaluated for inflammatory cell infiltration into the skin. Sites with visible inflammatory cell inflammation are scored as positive. Inflammatory cells may be neutrophilic, eosinophilic, monocytic or lymphocytic. At least a minimal perivascular infiltrate at the injection site is scored as positive, no infiltrate at the site of injection is scored as negative.

The following polypeptide tested positive in this assay: PRO1283, PRO1325 and PRO1343.

Example 142

Induction of c-fos in Endothelial Cells (Assay 34)

This assay is designed to determine whether PRO polypeptides show the ability to induce c-fos in endothelial cells. PRO polypeptides testing positive in this assay would be expected to be useful for the therapeutic treatment of conditions or disorders where angiogenesis would be beneficial including, for example, wound healing, and the like (as would agonists of these PRO polypeptides). Antagonists of the PRO polypeptides testing positive in this assay would be expected to be useful for the therapeutic treatment of cancerous tumors.

Human venous umbilical vein endothelial cells (HUVEC, Cell Systems) in growth media (50% Ham's F12 w/o GHT: low glucose, and 50% DMEM without glycine: with NaHCO3, 1% glutamine, 10 mM HEPES, 10% FBS, 10 ng/ml bFGF) were plated on 96-well microtiter plates at a cell density of $1 \times 10^4$ cells/well. The day after plating, the cells were starved by removing the growth media and treating the cells with 100 µl/well test samples and controls (positive control=growth media; negative control=Protein 32 buffer=10 mM HEPES, 140 mM NaCl, 4% (w/v) mannitol, pH 6.8). The cells were incubated for 30 minutes at 37° C., in 5% $CO_2$. The samples were removed, and the first part of the bDNA kit protocol (Chiron Diagnostics, cat. #6005-037) was followed, where each capitalized reagent/buffer listed below was available from the kit.

Briefly, the amounts of the TM Lysis Buffer and Probes needed for the tests were calculated based on information provided by the manufacturer. The appropriate amounts of thawed Probes were added to the TM Lysis Buffer. The Capture Hybridization Buffer was warmed to room temperature. The bDNA strips were set up in the metal strip holders, and 100 µl of Capture Hybridization Buffer was added to each b-DNA well needed, followed by incubation for at least 30 minutes. The test plates with the cells were removed from the incubator, and the media was gently removed using the vacuum manifold. 100 µl of Lysis Hybridization Buffer with Probes were quickly pipetted into each well of the microtiter plates. The plates were then incubated at 55° C. for 15 minutes. Upon removal from the incubator, the plates were placed on the vortex mixer with the microtiter adapter head and vortexed on the #2 setting for one minute. 80 µl of the lysate was removed and added to the bDNA wells containing the Capture Hybridization Buffer, and pipetted up and down to mix. The plates were incubated at 53° C. for at least 16 hours.

On the next day, the second part of the bDNA kit protocol was followed. Specifically, the plates were removed from the incubator and placed on the bench to cool for 10 minutes. The volumes of additions needed were calculated based upon information provided by the manufacturer. An Amplifier Working Solution was prepared by making a 1:100 dilution of the Amplifier Concentrate (20 fm/µl) in AL Hybridization Buffer. The hybridization mixture was removed from the plates and washed twice with Wash A. 50 µl of Amplifier Working Solution was added to each well and the wells were incubated at 53° C. for 30 minutes. The plates were then removed from the incubator and allowed to cool for 10 minutes. The Label Probe Working Solution was prepared by making a 1:100 dilution of Label Concentrate (40 pmoles/µl) in AL Hybridization Buffer. After the 10-minute cool-down period, the amplifier hybridization mixture was removed and the plates were washed twice with Wash A. 50 µl of Label Probe Working Solution was added to each well and the wells were incubated at 53° C. for 15 minutes. After cooling for 10 minutes, the Substrate was warmed to room temperature. Upon addition of 3 µl of Substrate Enhancer to each ml of Substrate needed for the assay, the plates were allowed to cool for 10 minutes, the label hybridization mixture was removed, and the plates were washed twice with Wash A and three times with Wash D. 50 µl of the Substrate Solution with Enhancer was added to each well. The plates were incubated for 30 minutes at 37° C. and RLU was read in an appropriate luminometer.

The replicates were averaged and the coefficient of variation was determined. The measure of activity of the fold increase over the negative control (Protein 32/HEPES buffer described above) value was indicated by chemiluminescence units (RLU). The results are considered positive if the PRO polypeptide exhibits at least a two-fold value over the negative buffer control. Negative control=1.00 RLU at 1.00% dilution. Positive control=8.39 RLU at 1.00% dilution.

The following PRO polypeptides tested positive in this assay: PRO1274, PRO1294, PRO1304 and PRO1130.

Example 143

Gene Amplification

This example shows that the PRO1295-, PRO1293-, PRO1265-, PRO1303-, PRO1269-, PRO1410-, PRO1317-, PRO1780-, PRO1555-, PRO1755-, PRO1558-, PRO1759- and PRO1788-encoding genes are amplified in the genome of certain human lung, colon and/or breast cancers and/or cell lines. Amplification is associated with overexpression of the gene product, indicating that the polypeptides are useful targets for therapeutic intervention in certain cancers such as colon, lung, breast and other cancers. Therapeutic agents may take the form of antagonists of PRO1295, PRO1293, PRO1265, PRO1303, PRO1269, PRO1410, PRO1317, PRO1780, PRO1555, PRO1755, PRO1558, PRO1759 and PRO1788 polypeptides, for example, murine-human chimeric, humanized or human antibodies against a PRO1295, PRO1293, PRO1265, PRO1303, PRO1269, PRO1410, PRO1317, PRO1780, PRO1555, PRO1755, PRO1558, PRO1759 or PRO1788 polypeptide.

The starting material for the screen was genomic DNA isolated from a variety of cancers. The DNA is quantitated precisely, e.g., fluorometrically. As a negative control, DNA was isolated from the cells of ten normal healthy individuals which was pooled and used as assay controls for the gene copy in healthy individuals (not shown). The 5' nuclease assay (for example, TaqMan™) and real-time quantitative PCR (for example, ABI Prizm7700 Sequence Detection System™ (Perkin Elmer, Applied Biosystems Division, Foster City, Calif.)), were used to find genes potentially amplified in certain cancers. The results were used to determine whether the DNA encoding PRO1295, PRO1293, PRO1265, PRO1303, PRO1269, PRO1410, PRO1317, PRO1780, PRO1555, PRO1755, PRO1558, PRO1759 and PRO1788 is over-represented in any of the primary lung or colon cancers or cancer cell lines or breast cancer cell lines that were screened. The primary lung cancers were obtained from individuals with tumors of the type and stage as indicated in Table 7. An explanation of the abbreviations used for the designation of the primary tumors listed in Table 7 and the primary tumors and cell lines referred to throughout this example has been given hereinbefore.

The results of the TaqMan™ are reported in delta (Δ) Ct units. One unit corresponds to 1 PCR cycle or approximately a 2-fold amplification relative to normal, two units corresponds to 4-fold, 3 units to 8-fold amplification and so on. Quantitation was obtained using primers and a TaqMan™ fluorescent probe derived from the PRO1295-, PRO1293-, PRO1265-, PRO1303-, PRO1269-, PRO1410-, PRO1317-, PRO1780-, PRO1555-, PRO1755-, PRO1558-, PRO1759- and PRO1788-encoding gene. Regions of PRO1295, PRO1293, PRO1265, PRO1303, PRO1269, PRO1410, PRO1317, PRO1780, PRO1555, PRO1755, PRO1558, PRO1759 and PRO1788 which are most likely to contain unique nucleic acid sequences and which are least likely to have spliced out introns are preferred for the primer and probe derivation, e.g., 3'-untranslated regions. The sequences for the primers and probes (forward, reverse and probe) used for the PRO1295, PRO1293, PRO1265, PRO1303, PRO1269, PRO1410, PRO1317, PRO1780, PRO1555, PRO1755, PRO1558, PRO1759 and PRO1788 gene amplification analysis were as follows:

```
PRO1295 (DNA59218-1559)

forward: 5'-AGGACTTGCCCTCAGGAA-3'           (SEQ ID NO:432)

reverse: 5'-CGCAGGACAGTTGTGAAAATA-3'        (SEQ ID NO:433)

probe:   5'-ATGACGCTCGTCCAAGGCCAAC-3'       (SEQ ID NO:434)
PRO1293 (DNA60618-1557)

forward: 5'-CCCACCTGTACCACCATGT-3'          (SEQ ID NO:435)

probe:   5'-ACTCCAGGCACCATCTGTTCTCCC-3'     (SEQ ID NO:436)

reverse: 5'-AAGGGCTGGCATTCAAGTU-3'          (SEQ ID NO:437)
PRO1265 (DNA60764-1533)

forward: 5'-TGACCTGGCAAAGGAAGAA-3'          (SEQ ID NO:438)

probe:   5'-CAGCCACCCTCCAGTCCAAGG-3'        (SEQ ID NO:439)

reverse: 5'-GGGTCGTGTTTTGGAGAGA-3'          (SEQ ID NO:440)
PRO1303 (DNA65409-1566)

forward: 5'-CTGGCCCTCAGAGCACCAAT-3'         (SEQ ID NO:441)

probe:   5'-TCCTCCATCACTTCCCCTAGCTCCA-3'    (SEQ ID NO:442)

reverse: 5'-CTGGCAGGAGTTAAAGTTCCAAGA-3'     (SEQ ID NO:443)
PRO1269 (DNA66520-1536)

forward: 5'-AAAGGACACCGGGATGTG-3'           (SEQ ID NO:444)

probe:   5'-AGCGTACACTCTCTCCAGGCAACCAG-3'   (SEQ ID NO:445)

reverse: 5'-CAATTCTGGATGAGGTGGTAGA-3'       (SEQ ID NO:446)
```

-continued

PRO1410 (DNA68874-1622)

forward: 5'-CAGGACTGAGCGCTTGTTTA-3'   (SEQ ID NO:447)

probe:   5'-CAAAGCGCCAAGTACCGGACC-3'  (SEQ ID NO:448)

reverse: 5'-CCAGACCTCAGCCAGGAA-3'     (SEQ ID NO:449)

PRO1317 (DNA71166-1685)

forward: 5'-CCCTAGCTGACCCCTTCA-3'     (SEQ ID NO:450)

reverse: 5'-TCTGACAAGCAGTTTTCTGAATC-3' (SEQ ID NO:451)

probe:   5'-CTCTCCCCCTCCCTTTTCCTTTGTTT-3' (SEQ ID NO:452)

PRO1780 (DNA71169-1709)

forward: 5'-CTCTGGTGCCCACAGTGA-3'     (SEQ ID NO:453)

probe:   5'-CCATGCCTGCTCAGCCAAGAA-3'  (SEQ ID NO:454)

reverse: 5'-CAGGAAATCTGGAAACCTACAGT-3' (SEQ ID NO:455)

PRO1555 (DNA73744-1665)

forward: 5'-CCITGAAAAGGACCCAGTTT-3'   (SEQ ID NO:456)

probe:   5'-ATGAGTCGCACCTGCTGTTCCC-3' (SEQ ID NO:457)

reverse: 5'-TAGCAGCTGCCCTTGGTA-3'     (SEQ ID NO:458)

forward: 5'-AACAGCAGGTGCGACTCATCTA-3' (SEQ ID NO:459)

probe:   5'-TGCTAGGCGACGACACCCAGACC-3' (SEQ ID NO:460)

reverse: 5'-TGGACACGTGGCAGTGGA-3'     (SEQ ID NO:461)

PRO1755 (DNA76396-1698)

forward: 5'-TCATGGTCTCGTCCCATTC-3'    (SEQ ID NO:462)

probe:   5'-CACCATTTGTTTCTCTGTCTCCCCATC-3' (SEQ ID NO:463)

reverse: 5'-CCGGCATCCTTGGAGTAG-3'     (SEQ ID NO:464)

PRO1788 (DNA77652-2505)

forward: 5'-TCCCCATTAGCACAGGAGTA-3'   (SEQ ID NO:465)

probe:   5'-AGGCTCTTGCCTGTCCTGCTGCT-3' (SEQ ID NO:466)

reverse: 5'-GCCCAGAGTCCCACTTGT-3'     (SEQ ID NO:467)

PRO1558 (DNA71282-1668)

forward: 5'-ACTGCTCCGCCTACTACGA-3'    (SEQ ID NO:468)

probe:   5'-AGGCATCCTCGCCGTCCTCA-3'   (SEQ ID NO:469)

reverse: 5'-AAGGCCAAGGTGAGTCCAT-3'    (SEQ ID NO:470)

forward: 5'-CGAGTGTGTGCGAAACCTAA-3'   (SEQ ID NO:471)

probe:   5'-TCAGGGTCTACATCAGCCTCCTGC-3' (SEQ ID NO:472)

reverse: 5'-AAGGCCAAGGTGAGTCCAT-3'    (SEQ ID NO:473)

PRO1759 (DNA76531-1701)

forward: 5'-CCTACTGAGGAGCCCTATGC-3'   (SEQ ID NO:474)

probe:   5'-CCTGAGCTGTAACCCCACTCCAGG-3' (SEQ ID NO:231)

reverse: 5'-AGAGTCTGTCCCAGCTATCTTGT-3' (SEQ ID NO:232)

The 5' nuclease assay reaction is a fluorescent PCR-based technique which makes use of the 5' exonuclease activity of Taq DNA polymerase enzyme to monitor amplification in real time. Two oligonucleotide primers are used to generate an amplicon typical of a PCR reaction. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

The 5' nuclease procedure is run on a real-time quantitative PCR device such as the ABI Prism 7700TM Sequence Detection. The system consists of a thermocycler, laser, charge-coupled device (CCD) camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data. 5' Nuclease assay data are initially expressed as Ct, or the threshold cycle. This is defined as the cycle at which the reporter signal accumulates above the background level of fluorescence. The ΔCt values are used as quantitative measurement of the relative number of starting copies of a particular target sequence in a nucleic acid sample when comparing cancer DNA results to normal human DNA results.

Table 7 describes the stage, T stage and N stage of various primary tumors which were used to screen the PRO1295, PRO1293, PRO1265, PRO1303, PRO1269, PRO1410, PRO1317, PRO1780, PRO1555, PRO1755, PRO1558, PRO1759 and PRO1788 compounds of the invention.

Cell culture lysis:

Cells were washed and trypsinized at a concentration of $7.5 \times 10^8$ per tip and pelleted by centrifuging at 1000 rpm for 5 minutes at 4° C., followed by washing again with ½ volume of PBS and recentrifugation. The pellets were washed a third time, the suspended cells collected and washed 2x with PBS. The cells were then suspended into 10 ml PBS. Buffer C1 was equilibrated at 4° C. Qiagen protease #19155 was diluted into 6.25 ml cold $ddH_2O$ to a final concentration of 20 mg/ml and equilibrated at 4° C. 10 ml of G2 Buffer was prepared by diluting Qiagen RNAse A stock (100 mg/ml) to a final concentration of 200 µg/ml.

Buffer C1 (10 ml, 4° C.) and ddH2O (40 ml, 4° C.) were then added to the 10 ml of cell suspension, mixed by inverting and incubated on ice for 10 minutes. The cell nuclei were pelleted by centrifuging in a Beckman swinging bucket rotor at 2500 rpm at 4° C. for 15 minutes. The supernatant was discarded and the nuclei were suspended with a vortex into 2 ml Buffer C1 (at 4° C.) and 6 ml $ddH_2O$, followed by a second 4° C. centrifugation at 2500 rpm for 15 minutes. The nuclei were then resuspended into the residual buffer using 200 µl per tip. G2 buffer (10 ml) was added to the suspended nuclei while gentle vortexing was

TABLE 7

Primary Lung and Colon Tumor Profiles

| Primary Tumor | Stage | Other Stage | Dukes Stage | T Stage | N Stage |
|---|---|---|---|---|---|
| Human lung tumor AdenoCa (SRCC724) [LT1] | IIA | | | T1 | N1 |
| Human lung tumor SqCCa (SRCC725) [LT1a] | IIB | | | T3 | N0 |
| Human lung tumor AdenoCa (SRCC726) [LT2] | IB | | | T2 | N0 |
| Human lung tumor AdenoCa (SRCC727) [LT3] | IIIA | | | T1 | N2 |
| Human lung tumor AdenoCa (SRCC728) [LT4] | IB | | | T2 | N0 |
| Human lung tumor SqCCa (SRCC729) [LT6] | IB | | | T2 | N0 |
| Human lung tumor Aden/SqCCa (SRCC730) [LT7] | IA | | | T1 | N0 |
| Human lung tumor AdenoCa (SRCC731) [LT9] | IB | | | T2 | N0 |
| Human lung tumor SqCCa (SRCC732) [LT10] | IIB | | | T2 | N1 |
| Human lung tumor SqCCa (SRCC733) [LT11] | IIA | | | T1 | N1 |
| Human lung tumor AdenoCa (SRCC734) [LT12] | IV | | | T2 | N0 |
| Human lung tumor AdenoSqCCa (SRCC735)[LT13] | IB | | | T2 | N0 |
| Human lung tumor SqCCa (SRCC736) [LT15] | IB | | | T2 | N0 |
| Human lung tumor SqCCa (SRCC737) [LT16] | IB | | | T2 | N0 |
| Human lung tumor SqCCa (SRCC738) [LT17] | IIB | | | T2 | N1 |
| Human lung tumor SqCCa (SRCC739) [LT18] | IB | | | T2 | N0 |
| Human lung tumor SqCCa (SRCC740) [LT19] | IB | | | T2 | N0 |
| Human lung tumor LCCa (SRCC741) [LT21] | IIB | | | T3 | N1 |
| Human lung AdenoCa (SRCC811) [LT22] | 1A | | | T1 | N0 |
| Human colon AdenoCa (SRCC742) [CT2] | | M1 | D | pT4 | N0 |
| Human colon AdenoCa (SRCC743) [CT3] | | | B | pT3 | N0 |
| Human colon AdenoCa (SRCC 744) [CT8] | | | B | T3 | N0 |
| Human colon AdenoCa (SRCC745) [CT10] | | A | | pT2 | N0 |
| Human colon AdenoCa (SRCC746) [CT12] | | MO, R1 | B | T3 | N0 |
| Human colon AdenoCa (SRCC747) [CT14] | | pMO, RO | B | pT3 | pN0 |
| Human colon AdenoCa (SRCC748) [CT15] | | M1, R2 | D | T4 | N2 |
| Human colon AdenoCa (SRCC749) [CT16] | | pMO | B | pT3 | pN0 |
| Human colon AdenoCa (SRCC750) [CT17] | | C1 | | pT3 | pN1 |
| Human colon AdenoCa (SRCC751) [CT1] | | MO, R1 | B | pT3 | N0 |
| Human colon AdenoCa (SRCC752) [CT4] | | | B | pT3 | M0 |
| Human colon AdenoCa (SRCC753) [CT5] | | G2 | C1 | pT3 | pN0 |
| Human colon AdenoCa (SRCC754) [CT6] | | pMO, RO | B | pT3 | pN0 |
| Human colon AdenoCa (SRCC755) [CT7] | | G1 | A | pT2 | pN0 |
| Human colon AdenoCa (SRCC756) [CT9] | | G3 | D | pT4 | pN2 |
| Human colon AdenoCa (SRCC757) [CT11] | | | B | T3 | N0 |
| Human colon AdenoCa (SRCC758) [CT18] | | MO, RO | B | pT3 | pN0 |

DNA Preparation:

DNA was prepared from cultured cell lines, primary tumors, and normal human blood. The isolation was performed using purification kit, buffer set and protease and all from Qiagen, according to the manufacturer's instructions and the description below.

applied. Upon completion of buffer addition, vigorous vortexing was applied for 30 seconds. Quiagen protease (200 µl, prepared as indicated above) was added and incubated at 50° C. for 60 minutes. The incubation and centrifugation were repeated until the lysates were clear (e.g., incubating additional 30–60 minutes, pelleting at 3000xg for 10 min., 4° C.).

Solid human tumor sample preparation and lysis:

Tumor samples were weighed and placed into 50 ml conical tubes and held on ice. Processing was limited to no more than 250 mg tissue per preparation (1 tip/preparation). The protease solution was freshly prepared by diluting into 6.25 ml cold ddH$_2$O to a final concentration of 20 mg/ml and stored at 4° C. G2 buffer (20 ml) was prepared by diluting DNAse A to a final concentration of 200 mg/ml (from 100 mg/ml stock). The tumor tissue was homogenated in 19 ml G2 buffer for 60 seconds using the large tip of the polytron in a laminar-flow TC hood in order to avoid inhalation of aerosols, and held at room temperature. Between samples, the polytron was cleaned by spinning at 2×30 seconds each in 2L ddH$_2$O, followed by G2 buffer (50 ml). If tissue was still present on the generator tip, the apparatus was disassembled and cleaned.

Quiagen protease (prepared as indicated above, 1.0 ml) was added, followed by vortexing and incubation at 50° C. for 3 hours. The incubation and centrifugation were repeated until the lysates were clear (e.g., incubating additional 30–60 minutes, pelleting at 3000×g for 10 min., 4° C.).

Human blood preparation and lysis:

Blood was drawn from healthy volunteers using standard infectious agent protocols and citrated into 10 ml samples per tip. Quiagen protease was freshly prepared by dilution into 6.25 ml cold ddH$_2$O to a final concentration of 20 mg/ml and stored at 4° C. G2 buffer was prepared by diluting RNAse A to a final concentration of 200 $\mu$g/ml from 100 mg/ml stock. The blood (10 ml) was placed into a 50 ml conical tube and 10 ml C1 buffer and 30 ml ddH$_2$O (both previously equilibrated to 4° C.) were added, and the components mixed by inverting and held on ice for 10 minutes. The nuclei were pelleted with a Beckman swinging bucket rotor at 2500 rpm, 4° C. for 15 minutes and the supernatant discarded. With a vortex, the nuclei were suspended into 2 ml C1 buffer (4° C.) and 6 ml ddH$_2$O (4° C.). Vortexing was repeated until the pellet was white. The nuclei were then suspended into the residual buffer using a 200 $\mu$l tip. G2 buffer (10 ml) was added to the suspended nuclei while gently vortexing, followed by vigorous vortexing for 30 seconds. Quiagen protease was added (200 $\mu$l) and incubated at 50° C. for 60 minutes. The incubation and centrifugation were repeated until the lysates were clear (e.g., incubating additional 30–60 minutes, pelleting at 3000×g for 10 min., 4° C.).

Purification of cleared lysates:

(1) Isolation of Genomic DNA:

Genomic DNA was equilibrated (1 sample per maxi tip preparation) with 10 ml QBT buffer. QF elution buffer was equilibrated at 50° C. The samples were vortexed for 30 seconds, then loaded onto equilibrated tips and drained by gravity. The tips were washed with 2×15 ml QC buffer. The DNA was eluted into 30 ml silanized, autoclaved 30 ml Corex tubes with 15 ml QF buffer (50° C.). Isopropanol (10.5 ml) was added to each sample, the tubes covered with parafin and mixed by repeated inversion until the DNA precipitated. Samples were pelleted by centrifugation in the SS-34 rotor at 15,000 rpm for 10 minutes at 4° C. The pellet location was marked, the supernatant discarded, and 10 ml 70% ethanol (4° C.) was added. Samples were pelleted again by centrifugation on the SS-34 rotor at 10,000 rpm for 10 minutes at 4° C. The pellet location was marked and the supernatant discarded. The tubes were then placed on their side in a drying rack and dried 10 minutes at 37° C., taking care not to overdry the samples.

After drying, the pellets were dissolved into 1.0 ml TE (pH 8.5) and placed at 50° C. for 1–2 hours. Samples were held overnight at 4° C. as dissolution continued. The DNA solution was then transferred to 1.5 ml tubes with a 26 gauge needle on a tuberculin syringe. The transfer was repeated 5× in order to shear the DNA. Samples were then placed at 50° C. for 1–2 hours.

(2) Quantitation of Gnomic DNA and Preparation for Gene Amplification Assay:

The DNA levels in each tube were quantified by standard $A_{260}/A_{280}$ spectrophotometry on a 1:20 dilution (5 $\mu$l DNA+ 95 $\mu$l ddH$_2$O) using the 0.1 ml quartz cuvettes in the Beckman DU640 spectrophotometer. $A_{260}/A_{280}$ ratios were in the range of 1.8–1.9. Each DNA sample was then diluted further to approximately 200 ng/ml in TE (pH 8.5). If the original material was highly concentrated (about 700 ng/$\mu$l), the material was placed at 50° C. for several hours until resuspended.

Fluorometric DNA quantitation was then performed on the diluted material (20–600 ng/ml) using the manufacturer's guidelines as modified below. This was accomplished by allowing a Hoeffer DyNA Quant 200 fluorometer to warm-up for about 15 minutes. The Hoechst dye working solution (#H33258, 10 $\mu$l, prepared within 12 hours of use) was diluted into 100 ml 1 ×TNE buffer. A 2 ml cuvette was filled with the fluorometer solution, placed into the machine, and the machine was zeroed. pGEM 3Zf(+) (2 $\mu$l, lot #360851026) was added to 2 ml of fluorometer solution and calibrated at 200 units. An additional 2 $\mu$l of pGEM 3Zf(+) DNA was then tested and the reading confied at 400+/−10 units. Each sample was then read at least in triplicate. When 3 samples were found to be within 10% of each other, their average was taken and this value was used as the quantification value.

The fluorometricly determined concentration was then used to dilute each sample to 10 ng/$\mu$l in ddH$_2$O. This was done simultaneously on all template samples for a single TaqMan plate assay, and with enough material to run 500–1000 assays. The samples were tested in triplicate with Taqman™ primers and probe both B-actin and GAPDH on a single plate with normal human DNA and no-template controls. The diluted samples were used provided that the CT value of normal human DNA subtracted from test DNA was +/−1 Ct. The diluted, lot-qualified genomic DNA was stored in 1.0 ml aliquots at −80° C. Aliquots which were subsequently to be used in the gene amplification assay were stored at 4° C. Each 1 ml aliquot is enough for 8–9 plates or 64 tests.

Gene amplification assay:

The PRO1295, PRO1293, PRO1265, PRO1303, PRO1269, PRO1410, PRO1317, PRO1780, PRO1555, PRO1755, PRO1558, PRO1759 and PRO1788 compounds of the invention were screened in the following primary tumors and the resulting ΔCt values which are ≧1.0 are reported in Table 8.

TABLE 8

ΔCt values in lung and colon primary tumors and cell line models

| Primary Tumors or Cell lines | PRO 1293 | PRO 1269 | PRO 1410 | PRO 1755 | PRO 1780 | PRO 1788 | PRO 1303 | PRO 1555 | PRO 1265 | PRO 1317 | PRO 1295 | PRO 1558 | PRO 1759 |
|---|---|---|---|---|---|---|---|---|---|---|---|---|---|
| LT1 | — | — | — | — | — | — | — | — | — | 1.15 | — | — | — |
| LT1-a | — | — | — | — | — | — | — | — | — | 1.49 | — | — | — |
| LT3 | — | — | — | — | — | — | — | — | 1.04 | — | — | — | — |
| LT4 | — | — | — | — | 1.16 | — | — | — | — | — | — | — | — |
| LT7 | — | — | — | — | 1.02 | — | — | — | — | — | — | — | — |
| LT9 | — | — | — | — | — | — | — | — | — | 1.26 | — | — | — |
| LT10 | — | — | — | — | — | — | — | — | — | 1.68 | — | — | — |
| LT12 | — | — | — | — | — | — | — | — | 2.17 | — | — | — | — |
| LT13 | — | — | 1.12 1.42 | — | — | — | 1.42 | 4.20 4.45 | 2.24 | — | — | — | — |
| LT15 | — | 1.22 | 2.10 1.82 | — | — | — | 1.17 | 1.36 1.15 | 3.51 | 1.16 | — | — | — |
| LT16 | — | 1.14 | 1.44 1.45 | 1.36 | — | — | 1.42 | 3.71 3.99 | 3.32 | — | — | — | — |
| LT17 | — | 1.26 | — | — | — | — | — | — | 1.02 | 1.74 | — | — | — |
| LT18 | — | — | — | 1.18 | — | — | — | — | — | — | — | — | — |
| CT2 | — | — | 2.36 | 2.35 | — | — | — | — | — | — | — | — | — |
| CT3 | — | — | 1.09 | — | — | 1.35 | — | — | — | — | — | — | — |
| CT8 | — | — | — | 1.64 | — | 1.26 | — | — | — | — | — | — | — |
| CT10 | — | — | 1.41 | 2.05 | — | 1.37 | — | — | — | — | — | — | — |
| CT12 | — | — | — | 1.15 | — | 1.24 | — | — | — | — | — | — | — |
| CT14 | — | — | 1.46 | 1.40 | — | 2.58 | — | — | — | — | — | — | — |
| CT15 | — | — | — | — | — | — | — | 1.34 1.62 | — | — | — | — | — |
| CT16 | — | — | — | — | — | — | 1.13 | 1.04 1.05 | — | — | — | — | — |
| CT17 | — | — | — | — | — | — | — | 1.16 | — | — | — | — | — |
| CT1 | — | — | — | — | — | 1.09 | — | — | — | — | — | — | — |
| CT4 | — | — | — | — | — | 1.22 | — | — | — | — | — | — | — |
| CT5 | — | — | 2.14 | — | — | — | — | — | — | — | — | — | — |
| CT9 | — | — | — | — | — | 1.52 | — | — | — | — | — | — | — |
| CT11 | — | — | 1.29 | — | — | — | — | — | — | — | — | — | — |
| A549 | — | — | — | — | — | — | 1.20 | 2.17 2.11 | — | — | — | — | — |
| Calu-1 | — | — | — | — | — | — | — | 1.39 | — | — | — | — | — |
| Calu-6 | — | — | — | — | — | — | — | 1.12 | — | — | — | — | — |
| H441 | — | — | — | — | — | — | — | 2.06 | — | — | — | — | — |
| H4660 | — | — | — | — | — | — | — | 1.88 | — | — | — | — | — |
| SKMES1 | — | — | — | — | — | — | — | 1.90 | — | — | — | — | — |
| SW620 | — | — | — | — | — | — | — | 2.24 | — | — | — | — | — |
| Colo320 | — | — | — | — | — | — | — | 2.21 2.24 | — | — | — | — | — |
| HT29 | — | — | 1.22 | — | — | — | — | — | — | — | — | — | — |
| HCT116 | — | — | — | — | — | — | — | 2.46 2.66 | — | — | — | — | — |
| LT22 | — | — | — | 1.26 | 1.07 | — | — | — | — | 2.69 | — | — | — |
| HF-000716 | — | — | — | — | — | — | — | 2.63 2.73 | — | — | — | — | — |
| HF-000733 | — | — | — | — | — | — | — | 2.58 2.71 1.39 | — | — | — | — | — |
| HF-000611 | — | — | — | — | — | — | — | 4.99 | — | — | — | — | — |
| HF-000539 | 2.33 | — | — | — | — | — | — | 3.13 2.55 | — | — | 1.49 | — | — |
| HF-000575 | — | — | — | — | — | — | — | 1.32 | — | — | — | — | — |
| HF-000698 | — | — | — | — | — | — | — | — | — | — | 1.09 | — | — |
| HF-000545 | — | — | — | — | — | — | — | 1.59 1.68 | — | — | 1.11 | — | — |
| HF-000631 | — | — | — | — | — | — | — | 1.37 | — | — | 1.27 | — | — |
| HF-000840 | 1.71 | — | — | — | — | — | — | 3.63 | — | — | 1.97 | 1.39 | 1.11 |
| HF-000842 | — | — | — | — | — | — | — | 1.99 | — | — | — | 1.24 | — |

TABLE 8-continued

ΔCt values in lung and colon primary tumors and cell line models

| Primary Tumors or Cell lines | PRO 1293 | PRO 1269 | PRO 1410 | PRO 1755 | PRO 1780 | PRO 1788 | PRO 1303 | PRO 1555 | PRO 1265 | PRO 1317 | PRO 1295 | PRO 1558 | PRO 1759 |
|---|---|---|---|---|---|---|---|---|---|---|---|---|---|
| HF-000795 | 1.13 | — | — | — | — | — | — | — | — | — | — | 1.01 | 1.32 |
| HF-001294 | — | — | — | — | — | — | — | — | — | — | — | 1.50 | — |
| HF-001296 | — | — | — | — | — | — | — | — | — | — | — | 2.88 | 1.51 |
| HF-001299 | — | — | — | — | — | — | — | — | — | — | — | 1.37 | — |

PRO1265

PRO1265 (DNA60764-1533) was also reexamined along with selected tumors from the above initial screen with framework mapping. Table 9 indicates the chromosomal mapping of the framework markers that were used in the present example. The framework markers are located approximately every 20 megabases and were used to control aneuploidy.

PRO1265 was also reexamined with epicenter mapping. The markers indicated in Table 10 are located in close proximity (in the genome) to DNA60764-1533, and are used to assess the relative amplification in the immediate vicinity of Chromosome 19 wherein the molecule is located. The distance between individual markers is measured in centirays (cR), which is a radiation breakage unit approximately equal to a 1% chance of a breakage between two markers. One cR is very roughly equivalent to 20 kilobases. The marker SHGC-33698 is closest to DNA60764-1533.

TABLE 9

Framework Markers Along Chromosome 19

| Map Position on Chromosome 19 | Stanford Human Genome Center Marker Name |
|---|---|
| S12 | AFMa107xc9 |
| S50 | SHGC-31335 |
| S105 | SHGC-34102 |
| S155 | SHGC-16175 |

TABLE 10

Epicenter Markers Along Chromosome 19 used for DNA60764-1533

| Map Position on Chromosome 19 | Stanford Human Genome Center Marker Name | Distance to next Marker (cR) |
|---|---|---|
| DNA34353 | — | maps to S158 |
| DNA40620 | — | maps to S160 |
| DNA54002 | — | maps to S160 |
| S160 | SHGC-34723 | 21 |
| DNA60764 | — | — |
| S161 | SHGC-30929 | 15 |
| S162 | SHGC-10328 | 17 |
| S163 | AFMa115wg5 | — |

TABLE 11

Amplification of framework markers relative to DNA60764-1533 (ΔCt)

| | Framework Markers | | | |
|---|---|---|---|---|
| Tumor | S12 | DNA60764-1533 | S50 | S105 | S155 |
|---|---|---|---|---|---|
| LT1 | 0.16 | 0.06 | −0.42 | 0.11 | −1.56 |
| LT1a | 0.05 | −0.27 | 0.17 | 0.40 | 0.00 |
| LT2 | 0.48 | 0.41 | 0.52 | 0.13 | −0.36 |
| LT3 | 0.27 | 0.83 | 0.11 | 0.50 | 1.04 |
| LT4 | 0.48 | 0.67 | 0.20 | 0.56 | −0.35 |
| LT6 | 0.72 | 0.74 | 0.32 | 0.35 | 0.24 |
| LT7 | 0.82 | 0.85 | 0.95 | 0.95 | 0.75 |
| LT9 | 0.72 | 0.61 | 0.19 | 0.64 | −0.35 |
| LT10 | 0.82 | 0.98 | 0.62 | 0.53 | 0.32 |
| LT11 | 0.13 | 0.25 | 0.55 | −0.34 | 0.70 |
| LT12 | 0.04 | 0.60 | 0.21 | −0.17 | 2.17 |
| LT13 | −0.06 | 0.57 | −0.30 | −0.05 | 2.24 |
| LT15 | −0.03 | −0.77 | 0.12 | −0.04 | 3.51 |
| LT16 | 0.46 | 1.37 | 0.51 | 0.23 | 3.32 |
| LT17 | 0.37 | 0.74 | 0.21 | 0.22 | 1.02 |
| LT18 | 0.39 | 0.57 | 0.11 | 0.16 | 0.52 |
| LT22 | 0.79 | 0.76 | −0.05 | 0.16 | 0.59 |

DISCUSSION AND CONCLUSION

PRO1269 (DNA66520-1536):

The ΔCt values for DNA66520-1536 in a variety of tumors are reported above. A ΔCt of >1 was typically used as the threshold value for amplification scoring, as this represents a doubling of gene copy. The above data indicates The ΔCt values of the above described framework markers along Chromosome 19 relative to PRO1265 are indicated for selected tumors in Table 11.

that significant amplification of nucleic acid DNA66520-1536 encoding PRO1269 occurred in primary lung tumors: LT15, LT16 and LT17. Because amplification of DNA66520-1536 occurs in various lung tumors, it is highly probable to play a significant role in tumor formation or growth. As a result, antagonists (e.g., antibodies) directed against the protein encoded by DNA66520-1536 (PRO1269) would be expected to have utility in cancer therapy.

PRO1410 (DNA68874-1622):

The ΔCt values for DNA68874-1622 in a variety of tumors are reported above. A ΔCt of >1 was typically used as the threshold value for amplification scoring, as this represents a doubling of gene copy. the above data indicates that significant amplification of nucleic acid DNA68874-1622 encoding PRO1410 occurred: (1) in primary lung tumors: LT13, LT15 and LT16; (2) in primary colon tumors: CT2, CT3, CT5, CT10, CT11, and CT14; and (3) in colon cell line HT29. Because amplification of DNA68874-1622 occurs in various lung and colon tumors, it is highly probable to play a significant role in tumor formation or growth. As a result, antagonists (e.g., antibodies) directed against the protein encoded by DNA68874-1622 (PRO1410) would be expected to have utility in cancer therapy.

PRO1755 (DNA76396-1698):

The ΔCt values for DNA76396-1698 in a variety of tumors are reported above. A ΔCt of >1 was typically used as the threshold value for amplification scoring, as this represents a doubling of gene copy. The above data indicates that significant amplification of nucleic acid DNA76396-1698 encoding PRO1755 occurred: (1) in primary lung tumors: LT16, LT18 and LT22; and (2) in primary colon tumors: CT2, CT8, CT10, CT12, and CT14. Because amplification of DNA76396-1698 occurs in various lung and colon tumors, it is highly probable to play a significant role in tumor formation or growth. As a result, antagonists (e.g., antibodies) directed against the protein encoded by DNA76396-1698 (PRO1755) would be expected to have utility in cancer therapy.

PRO1780 (DNA71169-1709):

The ΔCt values for DNA71169-1709 in a variety of tumors are reported above. A ΔCt of >1 was typically used as the threshold value for amplification scoring, as this represents a doubling of gene copy. The above data indicates that significant amplification of nucleic acid DNA71169-1709 encoding PRO1780 occurred in primary lung tumors: LT4, LT7 and LT22. Because amplification of DNA71169-1709 occurs in various lung tumors, it is highly probable to play a significant role in tumor formation or growth. As a result, antagonists (e.g., antibodies) directed against the protein encoded by DNA71169-1709 (PRO1780) would be expected to have utility in cancer therapy.

PRO1788 (DNA77652-2505):

The ΔCt values for DNA77652-2505 in a variety of tumors are reported above. A ΔCt of >1 was typically used as the threshold value for amplification scoring, as this represents a doubling of gene copy. The above data indicates that significant amplification of nucleic acid DNA77652-2505 encoding PRO1788 occurred in primary colon tumors: CT1, CT3, CT4, CT8, CT9, CT10, CT12, and CT14. Because amplification of DNA77652-2505 occurs in various colon tumors, it is highly probable to play a significant role in tumor formation or growth. As a result, antagonists (e.g., antibodies) directed against the protein encoded by DNA77652-2505 (PRO1788) would be expected to have utility in cancer therapy.

PRO1295 (DNA59218-1559):

The ΔCt values for DNA59218-1559 in a variety of tumors are reported above. A ΔCt of >1 was typically used as the threshold value for amplification scoring, as this represents a doubling of gene copy. The above data indicates that significant amplification of nucleic acid DNA59218-1559 encoding PRO1295 occurred: (1) in primary lung tumors: HF-000631 and HF-000840; (2) colon tumor centers: HF-000539 and HF-000698; and (3) in breast tumor center HF-000545. Because amplification of DNA59218-1559 occurs in various tumors, it is highly probable to play a significant role in tumor formation or growth. As a result, antagonists (e.g., antibodies) directed against the protein encoded by DNA59218-1559 (PRO1295) would be expected to have utility in cancer therapy.

PRO1293 (DNA60618-1557):

The ΔCt values for DNA60618-1557 in a variety of tumors are reported above. A ΔCt of >1 was typically used as the threshold value for amplification scoring, as this represents a doubling of gene copy. The above data indicates that significant amplification of nucleic acid DNA60618-1557 encoding PRO1293 occurred: (1) in primary lung tumor HF-000840; and (2) in colon tumor centers: HF-000539 and HF-000795. Because amplification of DNA60618-1557 occurs in various lung and colon tumors, it is highly probable to play a significant role in tumor formation or growth. As a result, antagonists (e.g., antibodies) directed against the protein encoded by DNA60618-1557 (PRO1293) would be expected to have utility in cancer therapy.

PRO1303 (DNA65409-1566):

The ΔCt values for DNA65409-1566 in a variety of tumors are reported above. A ΔCt of >1 was typically used as the threshold value for amplification scoring, as this represents a doubling of gene copy. The above data indicates that significant amplification of nucleic acid DNA65409-1566 encoding PRO1303 occurred: (1) in primary lung tumors: LT13, LT15 and LT16; (2) in lung cell line A549; and (3) in colon tumor CT16. Because amplification of DNA65409-1566 occurs in various tumors, it is highly probable to play a significant role in tumor formation or growth. As a result, antagonists (e.g., antibodies) directed against the protein encoded by DNA65409-1566 (PRO1566) would be expected to have utility in cancer therapy.

PRO1555 (DNA73744-1665):

The ΔCt values for DNA73744-1665 in a variety of tumors are reported above. A ΔCt of >1 was typically used as the threshold value for amplification scoring, as this represents a doubling of gene copy. The above data indicates that significant amplification of nucleic acid DNA73744-1665 encoding PRO1555 occurred: (1) in primary lung tumors: LT13, LT15, LT16, HF-000631, HF-000840, and HF-000842; (2) in lung cell lines: A549, Calu-1, Calu-6, H441, H460, and SKMES1; (3) in primary colon tumors: CT15, CT16, CT17, and colon tumor centers HF-000539 and HF-000575; (4) in colon cell lines: SW620, Colo320 and HCT116; (5) in breast tumor center HF-000545; (6) in kidney tumor center HF-000611; and (7) in testis tumor maargin HF-000716 and testis tumor center HF-000733. Because amplification of DNA73744-1665 occurs in various tumors, it is highly probable to play a significant role in tumor formation or growth. As a result, antagonists (e.g., antibodies) directed against the protein encoded by DNA73744-1665 (PRO1555) would be expected to have utility in cancer therapy.

PRO1265 (DNA60764-1533):

The ΔCt values for DNA60764-1533 in a variety of lung tumors are reported above. A ΔCt value of >1 was typically used as the threshold value for amplification scoring, as this represents a doubling of gene copy. The above data indicates that significant amplification of DNA60765-1533 occurred in primary lung tumors LT3, LT12, LT13, LT15, LT16 and LT17. The ΔCt values of these hits are 1.03, 2.17, 2.24, 3.51, 3.32 and 1.02. This represents an increase in gene copy of approximately 2.04, 4.50, 4.72, 11.39, 9.99 and 2.03.

Amplification has also been confirmed framework mapping for DNA60764-1533 in LT16. The reported ΔCt value was 1.37, which represents a 2.58 fold increase in gene copy relative to normal tissue. Epicenter mapping has also confirmed amplification of DNA60764-1533 in LT12, LT13, LT15, LT16, CT1, CT4, CT5, CT7 and CT 11. These tumors report ΔCt values of 2.35, 2.37, 3.88, 3.32 in the lung tumors and 1.74, 1.86, 3.28, 1.29 and 2.32 in the colon tumors. Relative to normal tissue, this represents an increase in gene copy of approximately 5.10, 5.17, 14.72 and 9.98 in the lung tumors and 3.34, 3.63, 9.71, 2.45 and 4.99 in the colon tumors.

In contrast, the amplification of the closest known framework markers, epicenter markers and the comparison sequences does not occur to a greater extent than that of DNA60764-1533. This strongly suggests that DNA60764-1533 is the gene responsible for the amplification of the particular region in Chromosome 19. Because amplification of DNA60764-1533 occurs in various lung and colon tumors, it is highly probably to play a significant role in tumor formation or growth. As a result, antagonists (e.g., antibodies) directed against the protein encoded by DNA60764-1533 would be expected to have utility in cancer therapy.

PRO1317 (DNA71166-1685):

The ΔCt values for DNA71166-1685 in a variety of tumors are reported above. A ΔCt of >1 was typically used as the threshold value for amplification scoring, as this represents a doubling of gene copy. The above data indicates that significant amplification of nucleic acid DNA71166-1685 encoding PRO1317 occurred in primary lung tumors LT1, LT1a, LT9, LT10, LT15, LT17 and LT22. Because amplification of DNA71166-1685 occurs in various tumors, it is likely associated with tumor formation and/or growth. As a result, antagonists (e.g., antibodies) directed against PRO1317 would be expected to be useful in cancer therapy.

SUMMARY

Because amplification of the various DNA's as described above occurs in various tumors, they are likely associated with tumor formation and/or growth. As a result, antagonists (e.g., antibodies) directed against these polypeptides would be expected to be useful in cancer therapy.

Example 144

Stimulatory Activity in Mixed Lymphocyte Reaction (MLR) Assay (Assay 24)

This example shows that certain polypeptides of the invention are active as a stimulator of the proliferation of stimulated T-lymphocytes. Compounds which stimulate proliferation of lymphocytes are useful therapeutically where enhancement of an immune response is beneficial. A therapeutic agent may take the form of antagonists of the polypeptide of the invention, for example, murine-human chimeric, humanized or human antibodies against the polypeptide.

The basic protocol for this assay is described in Current Protocols in Immunology, unit 3.12; edited by J E Coligan, A M Kruisbeek, D H Marglies, E M Shevach, W Strober, National Insitutes of Health, Published by John Wiley & Sons, Inc.

More specifically, in one assay variant, peripheral blood mononuclear cells (PBMC) are isolated from mammalian individuals, for example a human volunteer, by leukopheresis (one donor will supply stimulator PBMCs, the other donor will supply responder PBMCs). If desired, the cells are frozen in fetal bovine serum and DMSO after isolation. Frozen cells may be thawed overnight in assay media (37° C., 5% $CO_2$) and then washed and resuspended to $3\times10^6$ cells/ml of assay media (RPMI; 10% fetal bovine serum, 1% penicillin/streptomycin, 1% glutamine, 1% HEPES, 1% non-essential amino acids, 1% pyruvate). The stimulator PBMCs are prepared by irradiating the cells (about 3000 Rads).

The assay is prepared by plating in triplicate wells a mixture of:

100:1 of test sample diluted to 1% or to 0.1%,

50:1 of irradiated stimulator cells, and

50:1 of responder PBMC cells. 100 microliters of cell culture media or 100 microliter of CD4-IgG is used as the control. The wells are then incubated at 37° C., 5% $CO_2$ for 4 days. On day 5, each well is pulsed with tritiated thymidine (1.0 mC/well; Amersham). After 6 hours the cells are washed 3 times and then the uptake of the label is evaluated.

In another variant of this assay, PBMCs are isolated from the spleens of Balb/c mice and C57B6 mice. The cells are teased from freshly harvested spleens in assay media (RPMI; 10% fetal bovine serum, 1% penicillin/streptomycin, 1% glutamine, 1% HEPES, 1% non-essential amino acids, 1% pyruvate) and the PBMCs are isolated by overlaying these cells over Lympholyte M (Organon Teknika), centrifuging at 2000 rpm for 20 minutes, collecting and washing the mononuclear cell layer in assay media and resuspending the cells to $1\times10^7$ cells/ml of assay media. The assay is then conducted as described above.

Positive increases over control are considered positive with increases of greater than or equal to 180% being preferred. However, any value greater than control indicates a stimulatory effect for the test protein.

The following PRO polypeptides tested positive in this assay: PRO1246 and PRO1343.

Example 145

Mouse Kidney Mesangial Cell Proliferation Assay (Assay 92)

This assay shows that certain polypeptides of the invention act to induce proliferation of mammalian kidney mesangial cells and, therefore, are useful for treating kidney disorders associated with decreased mesangial cell function such as Berger disease or other nephropathies associated with Schönlein-Henoch purpura, celiac disease, dermatitis herpetiformis or Crohn disease. The assay is performed as follows. On day one, mouse kidney mesangial cells are plated on a 96 well plate in growth media (3:1 mixture of Dulbecco's modified Eagle's medium and Ham's F12 medium, 95% fetal bovine serum, 5% supplemented with 14 mM HEPES) and grown overnight. On day 2, PRO polypeptides are diluted at 2 concentrations(1% and 0.1%) in serum-free medium and added to the cells. Control samples are serum-free medium alone. On day 4, 20 $\mu$l of the Cell Titer 96 Aqueous one solution reagent (Progema) was added to each well and the colormetric reaction was allowed to proceed for 2 hours. The absorbance (OD) is then measured at 490 nm. A positive in the assay is anything that gives an absorbance reading which is at least 15% above the control reading.

The following polypeptide tested positive in this assay: PRO1265, PRO1244 and PRO1382.

Example 146

Induction of Pancreatic β-Cell Precursor Differentiation (Assay 89)

This assay shows that certain polypeptides of the invention act to induce differentiation of pancreatic β-cell precursor cells into mature pancreatic β-cells and, therefore, are useful for treating various insulin deficient states in mammals, including diabetes mellitus. The assay is performed as follows. The assay uses a primary culture of mouse fetal pancreatic cells and the primary readout is an alteration in the expression of markers that represent either β-cell precursors or mature β-cells. Marker expression is measured by real time quantitative PCR (RTQ-PCR); wherein the marker being evaluated is insulin.

The pancreata are dissected from E14 embryos (CD1 mice). The pancreata are then digested with collagenase/dispase in F12/DMEM at 37° C. for 40 to 60 minutes (collagenase/dispase, 1.37 mg/ml, Boehringer Mannheim, #1097113). The digestion is then neutralized with an equal volume of 5% BSA and the cells are washed once with RPM11640. At day 1, the cells are seeded into 12-well tissue culture plates (pre-coated with laminin, 20 µg/ml in PBS, Boehringer Mannheim, #124317). Cells from pancreata from 1–2 embryos are distributed per well. The culture medium for this primary cuture is 14F/1640. At day 2, the media is removed and the attached cells washed with RPMI/1640. Two mls of minimal media are added in addition to the protein to be tested. At day 4, the media is removed and RNA prepared from the cells and marker expression analyzed by real time quantitative RT-PCR. A protein is considered to be active in the assay if it increases the expression of the relevant β-cell marker as compared to untreated controls. 14F/1640 is RPMI1640 (Gibco) plus the following:

group A:1:1000
group B 1:1000
recombinant human insulin 10 µg/ml
Aprotinin (50µg/ml) 1:2000 (Boehringer manheim #981532)
Bovine pituitary extract (BPE) 60 µg/ml
Gentamycin 100 ng/ml
Group A: (in 10 ml PBS)
  Transferrin, 100 mg (Sigma T2252)
  Epidermal Growth Factor, 100 µg (BRL 100004)
  Triiodothyronine, 10 µl of $5 \times 10^{-6}$ M (Sigma T5516)
  Ethanolamine, 100 µl of $10^{-1}$ M (Sigma E0135)
  Phosphoethalamine, 100 µl of $10^{-1}$ M (Sigma P0503)
  Selenium, 4 µl of $10^{-1}$ M (Aesar #12574)
Group C: (in 10 ml 100% ethanol)
  Hydrocortisone, 2 µl of $5 \times 10^{-3}$ M (Sigma #H0135)
  Progesterone, 100 µl of $1 \times 10^{-3}$ M (Sigma #P6149)
  Forskolin, 500 µl of 20 mM (Calbiochem #344270)
Minimal media:
  RPMI 1640plus transferrin (10 µg/ml), insulin (1 µg/ml), gentamycin (100 ng/ml), aprotinin (50 µg/ml) and BPE (15 µg/ml).
Defined media:
  RPMI 1640 plus transferrin (10 µg/ml), insulin (1 µg/ml), gentamycin (100 ng/ml) and aprotinin (50 µg/ml).

The following polypeptides were positive in this assay: PRO1275 and PRO1474.

Example 147

Fetal Hemoglobin Induction in an Erythroblastic Cell Line (Assay 107)

This assay is usefull for screening PRO polypeptides for the ability to induce the switch from adult hemoglobin to fetal hemoglobin in an erythroblastic cell line. Molecules testing positive in this assay are expected to be useful for therapeutically treating various mammalian hemoglobin-associated disorders such as the various thalassemias. The assay is performed as follows. Erythroblastic cells are plated in standard growth medium at 1000 cells/well in a 96 well format. PRO polypeptides are added to the growth medium at a concentration of 0.2% or 2% and the cells are incubated for 5 days at 37° C. As a positive control, cells are treated with 100 µM hemin and as a negative control, the cells are untreated. After 5 days, cell lysates are prepared and analyzed for the expression of gamma globin (a fetal marker). A positive in the assay is a gamma globin level at least 2-fold above the negative control.

The following polypeptides tested positive in this assay: PRO1478, PRO1265, PRO1412, PRO1279, PRO1304, PRO1306, PRO1418, PRO1410 and PRO1575.

Example 148

Detection of Polypeptides That Affect Glucose and/or FFA Untake in Skeletal Muscle (Assay 106)

This assay is designed to determine whether PRO polypeptides show the ability to affect glucose or FFA uptake by skeletal muscle cells. PRO polypeptides testing positive in this assay would be expected to be useful for the therapeutic treatment of disorders where either the stimulation or inhibition of glucose uptake by skeletal muscle would be beneficial including, for example, diabetes or hyper- or hypo-insulinemia.

In a 96 well format, PRO polypeptides to be assayed are added to primary rat differentiated skeletal muscle, and allowed to incubate overnight. Then fresh media with the PRO polypeptide and +/– insulin are added to the wells. The sample media is then monitored to determine glucose and FFA uptake by the skeletal muscle cells. The insulin will stimulate glucose and FFA uptake by the skeletal muscle, and insulin in media without the PRO polypeptide is used as a positive control, and a limit for scoring. As the PRO polypeptide being tested may either stimulate or inhibit glucose and FFA uptake, results are scored as positive in the assay if greater than 1.5 times or less than 0.5 times the insulin control.

The following PRO polypeptides tested positive as either stimulators or inhibitors of glucose and/or FFA uptake in this assay: PRO1130, PRO1275, PRO1418, PRO1555 and PRO1787.

Example 149

Detection of PRO Polypeptides That Affect Glucose or FFA Uptake by Primary Rat Adipocytes (Assay 94)

This assay is designed to determine whether PRO polypeptides show the ability to affect glucose or FFA uptake by adipocyte cells. PRO polypeptides testing positive in this assay would be expected to be useful for the therapeutic treatment of disorders where either the stimulation or inhibition of glucose uptake by adipocytes would be beneficial including, for example, obesity, diabetes or hyper- or hypo-insulinemia.

In a 96 well format, PRO polypeptides to be assayed are added to primary rat adipocytes, and allowed to incubate overnight. Samples are taken at 4 and 16 hours and assayed for glycerol, glucose and FFA uptake. After the 16 hour incubation, insulin is added to the media and allowed to incubate for 4 hours. At this time, a sample is taken and glycerol, glucose and FFA uptake is measured. Media containing insulin without the PRO polypeptide is used as a positive reference control. As the PRO polypeptide being tested may either stimulate or inhibit glucose and FFA uptake, results are scored as positive in the assay if greater than 1.5 times or less than 0.5 times the insulin control.

The following PRO polypeptides tested positive as stimulators of glucose and/or FFA uptake in this assay: PRO1265, PRO1283, PRO1279, PRO1303, PRO1306, PRO1325, PRO1565 and PRO1567.

The following PRO polypeptides tested positive as inhibitors of glucose and/or FFA uptake in this assay: PRO1194, PRO1190, PRO1326, PRO1343, PRO1480, PRO1474, PRO1575 and PRO1760.

Example 150

Chondrocyte Re-differentiation Assay (Assay 110)

This assay shows that certain polypeptides of the invention act to induce redifferentiation of chondrocytes, therefore, are expected to be useful for the treatment of various bone and/or cartilage disorders such as, for example, sports injuries and arthritis. The assay is performed as follows. Porcine chondrocytes are isolated by overnight collagenase digestion of articulary cartilage of metacarpophalangeal joints of 4–6 month old female pigs. The isolated cells are then seeded at 25,000 cells/cm$^2$ in Ham F-12 containing 10% FBS and 4 µg/ml gentamycin. The culture media is changed every third day and the cells are then seeded in 96 well plates at 5,000 cells/well in 100 µl of the same media without serum and 100 µl of the test PRO polypeptide, 5 nM staurosporin (positive control) or medium alone (negative control) is added to give a final volume of 200 µl/well. After 5 days of incubation at 37° C., a picture of each well is taken and the differentiation state of the chondrocytes is determined. A positive result in the assay occurs when the redifferentiation of the chondrocytes is determined to be more similar to the positive control than the negative control.

The following polypeptide tested positive in this assay: PRO1265, PRO1250, PRO1430, PRO1356, PRO1275, PRO1274, PRO1286, PRO1273, PRO1283, PRO1279, PRO1306, PRO1325, PRO1343, PRO1418, PRO1565, PRO1474, PRO1787, PRO1556 and PRO1801.

Example 151

Induction of Pancreatic β-Cell Precursor Proliferation (Assay 117)

This assay shows that certain polypeptides of the invention act to induce an increase in the number of pancreatic β-cell precursor cells and, therefore, are useful for treating various insulin deficient states in mammals, including diabetes mellitus. The assay is performed as follows. The assay uses a primary culture of mouse fetal pancreatic cells and the primary readout is an alteration in the expression of markers that represent either β-cell precursors or mature β-cells. Marker expression is measured by real time quantitative PCR (RTQ-PCR); wherein the marker being evaluated is a transcription factor called Pdxl.

The pancreata are dissected from E14 embryos (CD1 mice). The pancreata are then digested with collagenase/dispase in F12/DMEM at 37° C. for 40 to 60 minutes (collagenase/dispase, 1.37 mg/ml, Boehringer Mannheim, #1097113). The digestion is then neutralized with an equal volume of 5% BSA and the cells are washed once with RPMI1640. At day 1, the cells are seeded into 12-well tissue culture plates (pre-coated with laminin, 20 µg/ml in PBS, Boehringer Mannheim, #124317). Cells from pancreata from 1–2 embryos are distributed per well. The culture medium for this primary cuture is 14F/1640. At day 2, the media is removed and the attached cells washed with RPMI/1640. Two mls of minimal media are added in addition to the protein to be tested. At day 4, the media is removed and RNA prepared from the cells and marker expression analyzed by real time quantitative RT-PCR. A protein is considered to be active in the assay if it increases the expression of the relevant β-cell marker as compared to untreated controls. 14F/1640 is RPMI1640 (Gibco) plus the following:
group A 1:1000
group B 1:1000
recombinant human insulin 10 µg/ml
Aprotinin (50 µg/ml) 1:2000 (Boehringer manheim #981532)
Bovine pituitary extract (BPE) 60 µg/ml
Gentamycin 100 ng/ml
Group A: (in 10 ml PBS)
Transferrin, 100 mg (Sigma T2252)
Epidermal Growth Factor, 100 µg (BRL 100004)
Triiodothyronine, 10 µl of 5×10$^{-6}$ M (Sigma T5516)
Ethanolamine, 100 µl of 10$^{-1}$ M (Sigma E0135)
Phosphoethalamine, 100 µl of 10$^{-1}$ M (Sigma P0503)
Selenium, 4 µl of 10$^{-1}$ M (Aesar #12574)
Group C: (in 10 ml 100% ethanol)
Hydrocortisone, 2 µl of 5×10$^{-3}$ M (Sigma #H0135)
Progesterone, 100 µl of 1×10$^{-3}$ M (Sigma #P6149)
Forskolin, 500 µl of 20 mM (Calbiochem #344270)
Minimal media:
RPMI 1640 plus transferrin (10 µg/ml), insulin (1 µg/ml), gentamycin (100 ng/ml), aprotinin (50 µg/ml) and BPE (15 µg/ml).
Defined media:
RPMI 1640 plus transferrin (10 µg/ml), insulin (1 µg/ml), gentamycin (100 ng/ml) and aprotin (50 µg/ml).

The following polypeptides tested positive in this assay: PRO1382 and PRO1561.

Example 152

Proliferation of Rat Utricular Supporting Cells (Assay 54)

This assay shows that certain polypeptides of the invention act as potent mitogens for inner ear supporting cells which are auditory hair cell progenitors and, therefore, are useful for inducing the regeneration of auditory hair cells and treating hearing loss in mammals. The assay is performed as follows. Rat UEC-4 utricular epithelial cells are aliquoted into 96 well plates with a density of 3000 cells/well in 200 µl of serum-containing medium at 33° C. The cells are cultured overnight and are then switched to serum-free medium at 37° C. Various dilutions of PRO polypeptides (or nothing for a control) are then added to the cultures and the cells are incubated for 24 hours. After the 24 hour incubation, $^3$H-thymidine (1 µCi/well) is added and the cells are then cultured for an additional 24 hours. The cultures are then washed to remove unincorporated radiolabel, the cells harvested and Cpm per well determined. Cpm of at least 30% or greater in the PRO polypeptide treated cultures as compared to the control cultures is considered a positive in the assay.

The following polypeptides tested positive in this assay: PRO1340.

Example 153

Chondrocyte Proliferation Assay (Assay 111)

This assay is designed to determine whether PRO polypeptides of the present invention show the ability to induce the proliferation and/or redifferentiation of chondrocytes in culture. PRO polypeptides testing positive in this assay would be expected to be useful for the therapeutic treatment of various bone and/or cartilage disorders such as, for example, sports injuries and arthritis.

Porcine chondrocytes are isolated by overnight collagenase digestion of articular cartilage of the metacarpophalangeal joint of 4–6 month old female pigs. The isolated cells are then seeded at 25,000 cells/cm$^2$ in Ham F-12 containing 10% FBS and 4 µg/ml gentamycin. The culture media is changed every third day and the cells are reseeded to 25,000 cells/cm² every five days. On day 12, the cells are seeded in 96 well plates at 5,000 cells/well in 100 µl of the same media without serum and 100 µl of either serum-free medium (negative control), staurosporin (final concentration of 5 nM; positive control) or the test PRO polypeptide are added to give a final volume of 200 µl/well. After 5 days at 37° C., 20 µl of Alamar blue is added to each well and the plates are incubated for an additional 3 hours at 37° C. The fluorescence is then measured in each well (Ex:530 nm; Em: 590 nm). The fluorescence of a plate containing 200 µl of the serum-free medium is measured to obtain the background. A positive result in the assay is obtained when the fluorescence of the PRO polypeptide treated sample is more like that of the positive control than the negative control.

The following PRO polypeptides tested positive in this assay: PRO1265, PRO1412, PRO1347, PRO1279, PRO1410 and PRO1474.

Example 154

Inhibition of Heart Neonatal Hypertrophy Induced by LIF+ET-1 (Assay 74)

This assay is designed to determine whether PRO polypeptides of the present invention show the ability to inhibit neonatal heart hypertrophy induced by LIF and endothelin-1 (ET-1). A test compound that provides a positive response in the present assay would be useful for the therapeutic treatment of cardiac insufficiency diseases or disorders characterized or associated with an undesired hypertrophy of the cardiac muscle.

Cardiac myocytes from 1-day old Harlan Sprague Dawley rats (180 µl at 7.5×10⁴/ml, serum <0.1, freshly isolated) are introduced on day 1 to 96-well plates previously coated with DMEM/F12+4% FCS. Test PRO polypeptide samples or growth medium alone (negative control) are then added directly to the wells on day 2 in 20 µl volume. LIF+ET-1 are then added to the wells on day 3. The cells are stained after an additional 2 days in culture and are then scored visually the next day. A positive in the assay occurs when the PRO polypeptide treated myocytes are visually smaller on the average or less numerous than the untreated myocytes.

The following PRO polypeptides tested positive in this assay: PRO1760.

Example 155

Tissue Expression Distribution

Oligonucleotide probes were constructed from some of the PRO polypeptide-encoding nucleotide sequences shown in the accompanying figures for use in quantitative PCR amplification reactions. The oligonucleotide probes were chosen so as to give an approximately 200–600 base pair amplified fragment from the 3' end of its associated template in a standard PCR reaction. The oligonucleotide probes were employed in standard quantitative PCR amplification reactions with cDNA libraries isolated from different human adult and/or fetal tissue sources and analyzed by agarose gel electrophoresis so as to obtain a quantitative determination of the level of expression of the PRO polypeptide-encoding nucleic acid in the various tissues tested. Knowledge of the expression pattern or the differential expression of the PRO polypeptide-encoding nucleic acid in various different human tissue types provides a diagnostic marker useful for tissue typing, with or without other tissue-specific markers, for determining the primary tissue source of a metastatic tumor, and the like. These assays provided the following results.

| DNA Molecule | Tissues With Significant Expression | Tissues Lacking Significant Expression |
|---|---|---|
| DNA19902-1669 | HUVEC cells, colon tumor | dendritic cells, lymphoblast cells, heart |
| DNA23322-1393 | uterus, colon tumor, prostate | cartilage |
| DNA26846-1397 | lymphoblast cells | uterus, heart, cartilage |
| DNA56107-1415 | spleen, substantia nigra, colon tumor | cartilage |
| DNA56406-1704 | THP-1 macrophages, uterus, spleen | endothelial cells, prostate, cartilage |
| DNA56529-1647 | liver, kidney, brain | adenocarcinoma, lung, bone marrow |
| DNA56862-1343 | endothelial cells, substantia nigra hippocampus | colon tumor, lymphoblast cells, uterus |
| DNA57254-1477 | kidney | lung, placenta, brain |
| DNA58730-1607 | bone marrow, kidney | lung, brain |
| DNA58732-1650 | lung, bone marrow | brain, liver |
| DNA58828-1519 | adenocarcinoma | lung, retina, small intestine |
| DNA58852-1637 | uterus | colon tumor, heart, brain |
| DNA59212-1627 | uterus | prostate, cartilage, heart |
| DNA59219-1613 | spleen, dendrocytes, prostate, uterus | substantia nigra, colon tumor, heart |
| DNA59817-1703 | bone marrow | lung, small intestine, placenta |
| DNA60278-1530 | prostate, colon tumor | uterus, cartilage |
| DNA60608-1577 | kidney, bone marrow | breast carcinoma, small intestine, lung |
| DNA60611-1524 | breast carcinoma | lung, small intestine, retina |
| DNA60740-1615 | breast carcinoma, adenocarcinoma | lung, small intestine, brain |
| DNA62809-1531 | THP-1 macrophages | uterus, spleen, brain, colon tumor |
| DNA62815-1576 | colon tumor, uterus, prostate | spleen, brain, heart, cartilage |
| DNA62845-1684 | liver, bone marrow | adenocarcinoma, lung, brain |
| DNA64849-1604 | kidney | lung, pancreas, liver, thyroid |
| DNA64863-1573 | lung, brain, kidney, bone marrow | liver, pancreas |
| DNA64881-1602 | uterus | heart, spleen, brain, endothelial cells |
| DNA64902-1667 | urerus | prostate, brain, heart, spleen |
| DNA64952-1568 | lung, brain | pancreas |
| DNA65403-1565 | spleen, dendrocytes, THP-1 macrophages | endothelial cells, colon tumor, lymphoblasts |
| DNA65408-1578 | prostate, spleen, dendrocytes | uterus, heart, substantia nigra |
| DNA65423-1595 | testis | breast carcinoma, retina, small intestine |
| DNA66512-1564 | heart, uterus, prostate, cartilage | endothelial cells |
| DNA66519-1535 | dendrocytes, lymphoblasts, uterus | substantia nigra, prostate, spleen |

-continued

| DNA Molecule | Tissues With Significant Expression | Tissues Lacking Significant Expression |
|---|---|---|
| DNA66521-1583 | uterus, heart, hippocampus | cartilage, dendrocytes, spleen |
| DNA66658-1584 | prostate, uterus, hippocampus, spleen | colon tumor, cartilage, heart |
| DNA66672-1586 | spleen | heart, prostate, brain, uterus |
| DNA66674-1599 | uterus, prostate | heart, brain, spleen, cartilage, colon tumor |
| DNA68836-1656 | kidney | lung, brain, bone marrow, liver |
| DNA68871-1638 | uterus, colon tumor, prostate | heart, cartilage, brain, spleen |
| DNA68880-1676 | heart, endothelial cells, brain, uterus | THP-1 macrophages |
| DNA68885-1678 | uterus, colon tumor, prostate | brain, heart, cartilage, endothelial cells |
| DNA71180-1655 | brain | lung, bone marrow, liver, kidney |
| DNA71184-1634 | breast carcinoma, bone marrow, testis | brain, adrenal gland |
| DNA71234-1651 | kidney, bone marrow | lung, brain, placenta |
| DNA71277-1636 | prostate, cartilage, heart, uterus | colon tumor, substantia nigra, endothelial cells |
| DNA71286-1687 | uterus, prostate, brain, cartilage | heart |
| DNA71883-1660 | aortic endothelial cells | lung, retina, small intestine, kidney |
| DNA73492-1671 | breast carcinoma, aortic endothelial cells bone marrow | lung, brain, testis |
| DNA73734-1680 | prostate, spleen | heart, cartilage, brain, uterus |
| DNA73735-1681 | prostate | brain, heart, cartilage, spleen |
| DNA73736-1657 | spleen, substantia nigra, hippocampus, cartilage | prostate, heart, uterus, dendrocytes |
| DNA73737-1658 | uterus | prostate, heart, spleen, cartilage |
| DNA73742-1662 | spleen, uterus, prostate | dendrocytes, colon tumor, endothelial cells |
| DNA73746-1654 | prostate | uterus, heart, brain, cartilage, spleen |
| DNA73760-1672 | breast carcinoma | retina, brain, kidney, liver, testis |
| DNA76393-1664 | endothelial cells, cartilage, uterus | brain, prostate |
| DNA76398-1699 | hippocampus, prostate, THP-1 macrtophages | heart, uterus, spleen, dendrocytes |
| DNA76399-1700 | IM-9 lymphoblasts | prostate, spleen, heart, cartilage, uterus |
| DNA76522-2500 | colon tumor | uterus, prostate, brain, heart, cartilage |
| DNA77301-1708 | brain | lung, small intestine, kidney, liver |
| DNA77648-1688 | retina, breast carcinoma, kidney, liver, bone marrow | brain, lung |
| DNA77568-1626 | brain | lung, liver, placenta, heart |
| DNA58727-1474 | HUVEC, dendrocytes, uterus | substantia nigra, hippocampus, prostate, colon tumor |
| DNA61185-1646 | colon tumor, HUVEC | uterus, dendrocytes, substantia nigra |
| DNA61608-1606 | colon tumor, dendrocytes, spleen, testis | substantia nigra, placenta |
| DNA66304-1546 | prostate, testis | uterus, brain, heart, colon tumor, adrenal gland |
| DNA71213-1659 | brain, spleen, HUVEC, colon tumor | prostate, uterus, heart, cartilage |
| DNA62812-1594 | heart | placenta, testis, uterus, adrenal gland, bone marrow, prostate |
| DNA66660-1585 | colon tumor, HUVEC, testis, placenta, uterus | bone marrow |
| DNA66669-1597 | heart, placenta, adrenal gland, uterus | cartilage, testis, colon tumor, HUVEC, bone marrow, prostate, spleen |
| DNA68866-1644 | testis, colon tumor, prostate, spleen, | cartilage, adrenal gland, HUVEC, placenta |
| DNA73730-1679 | testis, adrenal gland, uterus, prostate, uterus | cartilage, colon tumor, heart, placenta, spleen |

Deposit of Material

The following materials have been deposited with the American Type Culture Collection, 10801 University Blvd., Manassas, Va. 20110-2209, USA (ATCC):

TABLE 12

| Material | ATCC Dep. No. | Deposit Date |
|---|---|---|
| DNA19902-1669 | 203454 | Nov. 3, 1998 |
| DNA26846-1397 | 203406 | Oct. 27, 1998 |
| DNA56107-1415 | 203405 | Oct. 27, 1998 |
| DNA56406-1704 | 203478 | Nov. 17, 1998 |
| DNA56529-1647 | 203293 | Sep. 29, 1998 |
| DNA56531-1648 | 203286 | Sep. 29, 1998 |
| DNA56862-1343 | 203174 | Sep. 1, 1998 |
| DNA57254-1477 | 203289 | Sep. 29, 1998 |
| DNA57841-1522 | 203458 | Nov. 3, 1998 |
| DNA58727-1474 | 203171 | Sep. 1, 1998 |

TABLE 12-continued

| Material | ATCC Dep. No. | Deposit Date |
|---|---|---|
| DNA58730-1607 | 203221 | Sep. 15, 1998 |
| DNA58732-1650 | 203290 | Sep. 29, 1998 |
| DNA58828-1519 | 203172 | Sep. 1, 1998 |
| DNA58852-1637 | 203271 | Sep. 22, 1998 |
| DNA59212-1627 | 203245 | Sep. 9, 1998 |
| DNA59218-1559 | 203287 | Sep. 29, 1998 |
| DNA59219-1613 | 203220 | Sep. 15, 1998 |
| DNA59586-1520 | 203288 | Sep. 29, 1998 |
| DNA59817-1703 | 203470 | Nov. 17, 1998 |
| DNA60278-1530 | 203170 | Sep. 1, 1998 |
| DNA60608-1577 | 203126 | Aug. 18, 1998 |
| DNA60611-1524 | 203175 | Sep. 1, 1998 |
| DNA60618-1557 | 203292 | Sep. 29, 1998 |
| DNA60740-1615 | 203456 | Nov. 3, 1998 |
| DNA60764-1533 | 203452 | Nov. 10, 1998 |

TABLE 12-continued

| Material | ATCC Dep. No. | Deposit Date |
|---|---|---|
| DNA60775-1532 | 203173 | Sep. 1, 1998 |
| DNA61185-1646 | 203464 | Nov. 17, 1998 |
| DNA61608-1606 | 203239 | Sep. 9, 1998 |
| DNA62808-1326 | 203358 | Oct. 20, 1998 |
| DNA62809-1531 | 203237 | Sep. 9, 1998 |
| DNA62815-1578 | 203247 | Sep. 9, 1998 |
| DNA62845-1684 | 203361 | Oct. 20, 1998 |
| DNA64842-1632 | 203278 | Sep. 22, 1998 |
| DNA64849-1604 | 203468 | Nov. 17, 1998 |
| DNA64863-1573 | 203251 | Sep. 9, 1998 |
| DNA64881-1602 | 203240 | Sep. 9, 1998 |
| DNA64883-1526 | 203253 | Ser. 9, 1998 |
| DNA64885-1529 | 203457 | Nov. 3, 1998 |
| DNA64886-1601 | 203241 | Sep. 9, 1998 |
| DNA64888-1542 | 203249 | Sep. 9, 1998 |
| DNA64889-1541 | 203250 | Sep. 9, 1998 |
| DNA64897-1628 | 203216 | Sep. 15, 1998 |
| DNA64902-1667 | 203317 | Oct. 6, 1998 |
| DNA64903-1553 | 203223 | Sep. 15, 1998 |
| DNA64905-1558 | 203233 | Sep. 15, 1998 |
| DNA64950-1590 | 203224 | Sep. 15, 1998 |
| DNA64952-1568 | 203222 | Sep. 15, 1998 |
| DNA65402-1540 | 203252 | Sep. 9, 1998 |
| DNA65403-1565 | 203230 | Sep. 15, 1998 |
| DNA65404-1551 | 203244 | Sep. 9, 1998 |
| DNA65405-1547 | 203476 | Nov. 17, 1998 |
| DNA65406-1567 | 203219 | Sep. 15, 1998 |
| DNA65408-1578 | 203217 | Sep. 15, 1998 |
| DNA65409-1566 | 203232 | Sep. 15, 1998 |
| DNA65410-1569 | 203231 | Sep. 15, 1998 |
| DNA65423-1595 | 203227 | Sep. 15, 1998 |
| DNA66304-1546 | 203321 | Oct. 6, 1998 |
| DNA66511-1411 | 203228 | Sep. 15, 1998 |
| DNA66512-1564 | 203218 | Sep. 15, 1998 |
| DNA66519-1535 | 203236 | Sep. 15, 1998 |
| DNA66520-1536 | 203226 | Sep. 15, 1998 |
| DNA66521-1583 | 203225 | Sep. 15, 1998 |
| DNA66526-1616 | 203246 | Sep. 9, 1998 |
| DNA66658-1584 | 203229 | Sep. 15, 1998 |
| DNA66659-1593 | 203269 | Sep. 22, 1998 |
| DNA66663-1598 | 203268 | Sep. 22, 1998 |
| DNA66669-1597 | 203272 | Sep. 22, 1998 |
| DNA66672-1586 | 203265 | Sep. 22, 1998 |
| DNA66674-1599 | 203281 | Sep. 22, 1998 |
| DNA66675-1587 | 203282 | Sep. 22, 1998 |
| DNA67962-1649 | 203291 | Sep. 29, 1998 |
| DNA68836-1656 | 203455 | Nov. 3, 1998 |
| DNA68864-1629 | 203276 | Sep. 22, 1998 |
| DNA68866-1644 | 203283 | Sep. 22, 1998 |
| DNA68871-1638 | 203280 | Sep. 22, 1998 |
| DNA68874-1622 | 203277 | Sep. 22, 1998 |
| DNA68880-1676 | 203319 | Oct. 6, 1998 |
| DNA68885-1570 | 203311 | Oct. 6, 1998 |
| DNA71166-1685 | 203355 | Oct. 20, 1998 |
| DNA71169-1709 | 203467 | Nov. 17, 1998 |
| DNA71180-1655 | 203403 | Oct. 27, 1998 |
| DNA71184-1634 | 203266 | Sep. 22, 1998 |
| DNA71213-1659 | 203401 | Oct. 27, 1998 |
| DNA71234-1651 | 203402 | Oct. 27, 1998 |
| DNA71277-1636 | 203285 | Sep. 22, 1998 |
| DNA71282-1668 | 203312 | Oct. 6, 1998 |
| DNA71286-1604 | 203357 | Oct. 20, 1998 |
| DNA71883-1660 | 203475 | Nov. 17, 1998 |
| DNA73401-1633 | 203273 | Sep. 22, 1998 |
| DNA73492-1671 | 203324 | Oct. 6, 1998 |
| DNA73727-1673 | 203459 | Nov. 3, 1998 |
| DNA73730-1679 | 203320 | Oct. 6, 1998 |
| DNA73734-1680 | 203363 | Oct. 20, 1998 |
| DNA73735-1681 | 203356 | Oct. 20, 1998 |
| DNA73736-1657 | 203466 | Nov. 17, 1998 |
| DNA73737-1658 | 203412 | Oct. 27, 1998 |
| DNA73739-1645 | 203270 | Sep. 22, 1998 |
| DNA73742-1662 | 203316 | Oct. 6, 1998 |
| DNA73744-1665 | 203322 | Oct. 6, 1998 |
| DNA73746-1654 | 203411 | Oct. 27, 1998 |
| DNA73760-1672 | 203314 | Oct. 6, 1998 |
| DNA76396-1698 | 203471 | Nov. 17, 1998 |
| DNA76398-1699 | 203474 | Nov. 17, 1998 |
| DNA76399-1700 | 203472 | Nov. 17, 1998 |
| DNA76401-1683 | 203360 | Oct. 20, 1998 |
| DNA76510-2504 | 203477 | Nov. 17, 1998 |
| DNA76522-2500 | 203469 | Nov. 17, 1998 |
| DNA76529-1666 | 203315 | Oct. 6, 1998 |
| DNA76531-1701 | 203465 | Nov. 17, 1998 |
| DNA76532-1702 | 203473 | Nov. 17, 1998 |
| DNA76538-1670 | 203313 | Oct. 6, 1998 |
| DNA76541-1675 | 203409 | Oct. 27, 1998 |
| DNA77301-1708 | 203407 | Oct. 27, 1998 |
| DNA77303-2502 | 203479 | Nov. 17, 1998 |
| DNA77648-1688 | 203408 | Oct. 27, 1998 |
| DNA77652-2505 | 203480 | Nov. 17, 1998 |
| DNA83500-2506 | 203391 | Oct. 29, 1998 |
| DNA77568-1626 | 203134 | Aug. 18, 1998 |
| DNA23322-1393 | 203400 | Oct. 27, 1998 |
| DNA59814-1486 | 203359 | Oct. 20, 1998 |
| DNA62812-1594 | 203248 | Sep. 9, 1998 |
| DNA66660-1585 | 203279 | Sep. 22, 1998 |
| DNA76393-1664 | 203323 | Oct. 6, 1998 |

These deposit were made under the provisions of the Budapest Treaty on the International Recognition of the Deposit of Microorganisms for the Purpose of Patent Procedure and the Regulations there under (Budapest Treaty). This assures maintenance of a viable culture of the deposit for 30 years from the date of deposit and for at least five (5) years after the most recent request for the furnishing of a sample of the deposit received by the depository. The deposits will be made available by ATCC under the terms of the Budapest Treaty, and subject to an agreement between Genentech, Inc. and ATCC, which assures that all restrictions imposed by the depositor on the availability to the public of the deposited material will be irrevocably removed upon the granting of the pertinent U.S. patent, assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 USC § 122 and the Commissioner's rules pursuant thereto (including 37 CFR § 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the invention in contravention of the rights granted under the authority of any government in accordance with its patent laws.

The foregoing written specification is considered to be sufficient to enable one skilled in the art to practice the invention. The present invention is not to be limited in scope by the construct deposited, since the deposited embodiment is intended as a single illustration of certain aspects of the invention and any constructs that are funtionally equivalent are within the scope of this invention. The deposit of material herein does not constitute an admission that the written description herein contained is inadequate to enable the practice of any aspect of the invention, including the best mode thereof, nor is it to be construed as limiting the scope of the claims to the specific illustrations that it represents. Indeed, various modifications of the invention in addition to those shown and described herein will become apparent to those skilled in the art from the foregoing description and fall within the scope of the appended claims.

SEQUENCE LISTING (477 sequences)

SEQ ID NO: 1 - DNA, 43 bp, Artificial Sequence
  Synthetic oligonucleotide probe
tgtaaaacgacggccagttaaatagacctgcaattattaatct

SEQ ID NO: 2 - DNA, 41 bp, Artificial Sequence
  Synthetic oligonucleotide probe
caggaaacagctatgaccacctgcacacctgcaaatccatt

SEQ ID NO: 3 - DNA, 1110 bp, Homo sapiens
ccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgccwctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagt

SEQ ID NO: 4 - protein, 245 aa, Homo sapiens
  sig_peptide 1-42: Signal Peptide
  TRANSMEM 19-42, 61-83, 92-114, 209-230: Transmembrane Domains
  misc_feature 69-80, 211-222: Prokaryotic Membrane Lipoprotein Lipid Attachment Site.
  misc_feature 75-81, 78-84, 210-216, 214-220, 226-232: N-Myristoylation Site.
  misc_feature 134-138: N-Glycosylation Site.
  misc_feature 160-168, 160-169: Tyrosine Kinase Phosphorylation Site.
  unsure 233: unknown amino acid
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCXSRAITNNQYEIV

SEQ ID NO: 5 - DNA, 1218 bp, Homo sapiens
cccacgcgtccggcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccagaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataagtaagtatctgactcacggtcacctccagtggaatgaaaagtgttctgcccggaaccatgactttaggactccttcagttcctttaggacatactcgccaagccttgtgctcacagggcaaaggagaatattttaatgctccgctgatggcagagtaaatgataagatttgatgtttttgcttgctgtcatctactttgtctggaaatgtctaaatgtttctgtagcagaaaacacgataaagctatgatctttattagag

SEQ ID NO: 6 - protein, 117 aa, Homo sapiens
  sig_peptide 1-16: Signal Peptide
  misc_feature 18-24, 32-38, 34-40, 35-41, 51-57: N-Myristoylation Site.
  misc_feature 22-26, 50-54, 113-117: Casein Kinase II Phosphorylation Site.
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDK

SEQ ID NO: 7 - DNA, 756 bp, Homo sapiens
ggcacgaggcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatgaaaaaaaaaaaaaaaaaaa

SEQ ID NO: 8 - protein, 189 aa, Homo sapiens
  sig_peptide 1-24: Signal Peptide
  misc_feature 4-10, 5-11, 47-53, 170-176, 176-182: N-Myristoylation Site.
  misc_feature 44-85: G-protein Coupled Receptors Proteins.
  misc_feature 54-65: Prokaryotic Mmembrane Lipoprotein Lipid Attachment Site.
  misc_feature 82-86: Casein Kinase II Phosphorylation Site.
  TRANSMEM 86-103, 60-75: Transmembrane Domain
  misc_feature 144-151: Tyrosine Kinase Phosphorylation Site.
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 9 - DNA, 1508 bp, Homo sapiens
aattcagattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaacccaaaaaaaaaaaaaaaaaaaaaaaaaaaaaaaaaaaaaaaa

SEQ ID NO: 10 - protein, 319 aa, Homo sapiens
  sig_peptide 1-17: Signal Peptide
  misc_feature 36-47, 108-113, 166-171,198-203, 207-212: N-myristoylation Sites.
  misc_feature 39-42: Glycosaminoglycan Attachment Site.
  TRANSMEM 136-152: Transmembrane Domain
  misc_feature 161-163, 187-190 and 253-256: N-glycosylation Sites.
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 11 - DNA, 2720 bp, Homo sapines
gcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgcaa

SEQ ID NO: 12 - protein, 699 aa, Homo sapiens
  TRANSMEM 21-40 and 84-105: Transmembrane Domain (type II)
MAACEGRRSGALGSSQSDFLTPPVGGAPWAVATTVVMYPPPPPPPHRDFISVTLSFGESYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 13 - DNA, 24 bp, Artificial Sequence
  Synthetic oligonucleotide probe
cgccagaagggcgtgattgacgtc

SEQ ID NO: 14 - DNA, 24 bp, Artificial Sequence
  Synthetic oligonucleotide probe
ccatccttcttcccagacaggccg

SEQ ID NO: 15 - DNA, 44 bp, Artificial Sequence
  Synthetic oligonucleotide probe
gaagcctgtgtccaggtccttcagtgagtggtttggcctcggtc

SEQ ID NO: 16 - DNA, 1524 bp, Homo sapiens
ggcgccgcgtaggcccgggaggccgggccggccgggctgcgagcgcctgccccatgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcaccctactctgacctccttcacgtgcccaggcctgtgggtagtggggagggctgaacaggacaacctctcatcacccccaaaaaaaaaaaaaaaaaaaaaaaaaaaaaaaaaaaaaaaaaaaaaaa

SEQ ID NO: 17 - protein, 327 aa, Homo sapiens
  sig_peptide 1-42: Signal peptide.
  misc_feature 19-25,65-71,247-253,285-291,303-310: N-myristoylation site.
  misc_feature 27-31: cAMP- and cGMP-dependent protein kinase phosphorylation site.
  TRANSMEM 29-49: Transmembrane domain (type II).
  misc_feature 154-158: N-glycosylation site.
  misc_feature 226-233: Tyrosine kinase phosphorylation site.
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 18 - DNA, 23 bp, Artificial Sequence
  Synthetic oligonucleotide probe
gcgaacgcttcgaggagtcctgg

SEQ ID NO: 19 - DNA, 24 bp, Artificial Sequence
  Synthetic oligonucleotide probe
gcagtgcgggaagccacatggtac

SEQ ID NO: 20 - DNA, 46 bp, Artificial Sequence
  Synthetic oligonucleotide probe
cttcctgagcaggaagaagatccggcaccacatctacgtgctcaac

SEQ ID NO: 21 - DNA, 494 bp, Homo sapiens
caatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgaaaaaaaaaaaaaaaaaaaaaaaaaaa

SEQ ID NO: 22 - protein, 73 aa, Homo sapiens
  sig_peptide 1-15: Signal peptide.
  misc_feature 3-18: Growth factor and cytokines receptors family.
MLLLTLLLLLLLLKGSCLEWGLVGAQKVSSATDAPIRDWAFFPPSFLCLLPHRPAMTCSQAQPRGEGEKVGDG

SEQ ID NO: 23 - DNA, 2883 bp, Homo sapiens
gggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggtatgttacattctgcaatcatttaagactatttacagttaaattagaatgctccaaatgttctgcttcgcaaaataaccttattaaaagatttttttttgcaggaagataggtattattgcttttgctactgttttaaagaaaactaaccaggaagaactgcattacgactttcaagggccctaggcatttttgcctttgattccctttcttcacataaaaatatcagaaattacattttataactgcagtggtataaatgcaaatatactattgttacatgtgaaaaaattttatttgacttaaaagtttatttatttgtttttttgctcctgattttaagacaataagatgttttcatgggcccctaaaagtatcatgagcctttggcactgcgcctgccaagcctagtggagaagtcaaccctgagaccaggtgtttaatcaagcaagctgtatatcaaaatttttggcagaaaacacaaatatgtcatatatctttttttaaaaaaagtatttcattgaagcaagcaaaatgaaagcatttttactgatttttaaaattggtgctttagatatatttgactacactgtattgaagcaaatagaggaggcacaactccagcaccctaatggaaccacatttttttcacttagctttctgtgggcatgtgtaattgtattctctgcggtttttaatctcacagtactttatttctgtcttgtccctcaataatatcacaaacaatattccagtcattttaatggctgcataataactgatccaacaggtgttaggtgttctggtttagtgtgagcactcaataaatattgaatgaatgaacgaaaaaaaaaaaaaaaa

SEQ ID NO: 24 - protein, 616 aa, Homo sapiens
  sig_peptide 1-33: Signal peptide.
  TRANSMEM 13-40: Transmembrane domain (type II).
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKVCYILQSFKTIYS

SEQ ID NO: 25 - DNA, 24 bp, Artificial Sequence
  Synthetic oligonucleotide probe
gaggactcaccaatctggttcggc

SEQ ID NO: 26 - DNA, 24 bp, Artificial Sequence
  Synthetic oligonucleotide probe
aactggaaaggaaggctgtctccc

SEQ ID NO: 27 - DNA, 50 bp, Artificial Sequence
  Synthetic oligonucleotide probe
gtaaaggagaagaacatcacggtacgggataccaggtgtgtttatcctaa

SEQ ID NO: 28 - DNA, 683 bp, Homo sapiens
gcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatcc

SEQ ID NO: 29 - protein, 81 aa, Homo sapiens
  sig_peptide 1-21: Signal peptide.
MSRSSKVVLGLSVLLTAATVAGVHVKQQWDQQRLRDGVIRDIERQIRKKENIRLLGEQIILTEQLEAEREKMLLAKGSQKS

SEQ ID NO: 30 - DNA, 2128 bp, Homo sapiens
ctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttcttttttttttttttttttaagacggattctcactctgtggcccaggctggagtgcagtggtgcgatctcagctcactgcaacccccgcctcctgggttcaagcgattctcctcccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaag

SEQ ID NO: 31 - protein, 322 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 32 - DNA, 3680 bp, Homo sapiens
gaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggtcacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctccatctcctctgggtgctgggaaagtggaggattagctgaagttttgcttctcggggcctgtctgaatctccattgctttctgggaggacataattcacctgtcctagcttcttatcatcttacatttccctgtagccactgggacatatgtggtgttccttcctagctcctgtctcctcctcatgcctttgctgggtatgggcatgttagggggaaggtcattgctgtcagaggggcactgactttctaatggtgttacccaaggtgaatgttggagacacagtcgcgatgctgcccaagtcccggcgagccctaactatccaggagatcgctgcgctggccaggtcctccctgcatggtatgcagcccctcccatgtttctggccactttgtcctttctcctcccgtttgcacatccctttggaactgtttcctgtgagtacatgctggggtctcccctttcttcccttgctcaggtgaatctcagccccttctcccacccaaaggttcacatggatcctaactactgccacccttccacctccctgcacctgtgctccctggcctggtcctttaccaggcttctccaccctcccctatctccaggtatttcccaggtggtgaaggaccacgtgaccaagcctaccgccatggcccagggccgagtggctcacctcattgagtggaagggctggagcaagccgagtgactcacctgctgccctggaatcagccttttcctcctattcagacctcagcgagggcgaacaagaggctcgctttgcagcaggagtggctgagcagtttgccatcgcggaagccaagctccgagcatggtcttcggtggatggcgaggactccactgatgactcctatgatgaggactttgctgggggaatggacacagacatggctgggcagctgcccctggggccgcacctccaggacctgttcaccggccaccggttctcccggcctgtgcgccagggctccgtggagcctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgccaggggcagagcctctgtgcccaagtgtgggctcaaggctcccagcagagctccacagcctagagggctcctgggagcgctcgcttctccgttgtgtgttttgcatgaaagtgtttggagaggaggcaggggctgggctgggggcgcatgtcctgcccccactcccggggcttgccgggggttgcccggggcctctggggcatggctacagctgtggcagacagtgatgttcatgttcttaaaatgccacacacacatttcctcctcggataatgtgaaccactaagggggttgtgactgggctgtgtgagggtggggtgggagggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctaaaa

SEQ ID NO: 33 - protein, 335 aa, Homo sapiens
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 34 - DNA, 25 bp, Artificial Sequence
  Synthetic oligonucleotide probe
tgtcctttgtcccagacttctgtcc

SEQ ID NO: 35 - DNA, 50 bp, Artificial Sequence
  Synthetic oligonucleotide probe
ctggatgctaatgtgtccagtaaatgatccccttatcccgtcgcgatgct

SEQ ID NO: 36 - DNA, 25 bp, Artificial Sequence
  Synthetic oligonucleotide probe
ttccactcaatgaggtgagccactc

SEQ ID NO: 37 - DNA, 23 bp, Artificial Sequence
  Synthetic oligonucleotide probe
ggcgagccctaactatccaggag

SEQ ID NO: 38 - DNA, 39 bp, Artificial Sequence
  Synthetic oligonucleotide probe
ggagatcgctgcgctggccaggtcctccctgcatggtat

SEQ ID NO: 39 - DNA, 22 bp, Artificial Sequence
  Synthetic oligonucleotide probe
ctgctgcaaagcgagcctcttg

SEQ ID NO: 40 - DNA, 2084 bp, Homo sapiens
ggttcctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcatcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaacaatgaagatgactctttactgctctgcctgaagccctagtaccataattcaagattgcattttcttaaatgaaaattgaaagggtgctttttaaagaaaatttgacttaaagctaaaaagaggacatagcccagagtttctgttattgggaaattgaggcaatagaaatgacagacctgtattctagtacgttataattttctagatcagcacacacatgatcagcccactgagttatgaagctgacaatgactgcattcaacggggccatggcaggaaagctgaccctacccaggaaagtaatagcttctttaaaagtcttcaaaggttttgggaattttaacttgtcttaatatatcttaggcttcaattatttgggtgccttaaaaactcaatgagaatcatggt

SEQ ID NO: 41 - protein, 334 aa, Homo sapiens
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 42 - DNA, 1594 bp, Homo sapiens
aacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaaaactactaaccactgcaagctcttgtcaaattttagtttaattggcattgcttgttttttgaaactgaaattacatgagtttcattttttctttgcatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaaaaaaaaaaaaaaaaaaa

SEQ ID NO: 43 - protein, 263 aa, Homo sapiens
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 44 - DNA, 24 bp, Artificial Sequence
  Synthetic oligonucleotide probe
gaaagacacgacacagcagcttgc

SEQ ID NO: 45 - DNA, 20 bp, Artificial Sequence
  Synthetic oligonucleotide probe
gggaactgctatctgatgcc

SEQ ID NO: 46 - DNA, 26 bp, Artificial Sequence
  Synthetic oligonucleotide probe
caggatctcctcttgcagtctgcagc

SEQ ID NO: 47 - DNA, 28 bp, Artificial Sequence
  Synthetic oligonucleotide probe
cttctcgaaccacataagtttgaggcag

SEQ ID NO: 48 - DNA, 25 bp, Artificial Sequence
  Synthetic oligonucleotide probe
cacgattccctccacagcaactggg

SEQ ID NO: 49 - DNA, 1969 bp, Homo sapiens
ggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctgctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatcccccaaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcctgaaaaaaaaaaaaaaaaaaaaaaaaaaaaaaaaaaaaaaaaaaaaaaaaaaaaaaaaga

SEQ ID NO: 50 - protein, 283 aa, Homo sapiens
MVSAAAPSLLILLLLLLGSVPATDARSVPLKATFLEDVAGSGEAEGSSASSPSLPPPWTPALSPTSMGPQPTTLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 51 - DNA, 1734 bp, Homo sapiens
gtggactctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgcagcagatgctttgggcaacagggtcggggaagcagcccatgctctgggaaacactgggcacgagattggcagacaggcagaagatgtcattcgacacggagcagatgctgtccgcggctcctggcagggggtgcctggccacagtggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatcgggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 52 - protein, 440 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGAADALGNRVGEAAHALGNTGHEIGRQAEDVIRHGADAVRGSWQGVPGHSGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 53 - DNA, 3580 bp, Homo sapiens
gaccggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgcgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaaaaaaaaaaaaaaaaaaagggcggccgcccttttttttttttttttttttttttttttttttttttttttttttttttaaaaagggcttttattaaaattctccccacacgatggctcctgcaatctgccacagctctggggcgtgtcctgtagggaaaggccctgttttccctgaggcggggctgggcttgtccatgggtccgcggagctggccgtgcttggcgccctggcgtgtgtctagctgcttcttgccgggcacagagctgcggggtctgggggcaccgggagctaagagcaggctctggtgcaggggtggaggcctgtctcttaaccgacaccctgaggtgctcctgagatgctgggtccaccctgagtggcacggggagcagctgtggccggtgctccttcytaggccagtcctggggaaactaagctcgggcccttctttgcaaagaccgaggatggggtgggtgtgggggactcatggggaatggcctgaggagctacgtgtgaagagggcgccggtttgttggctgcagcggcctggagcgcctctctcctgagcctcagtttccctttccgtctaatgaagaacatgccgtctcggtgtctcagggctattaggacttgccctcaggaagtggccttggacgagcgtcatgttattttcacaactgtcctgcgacgttggcctgggcacgtcatggaatggcccatgtccctctgctgcgtggacgtcgcggtcgggagtgcgcagccagaggcggggccagacgtgcgcctgggggtgaggggaggcgccccgggagggcctcacaggaagttgggctcccgcaccaccaggcagggcgggctcccgccgccgccgccgccaccaccgtccaggggccggtagacaaagtggaagtcgcgcttgggctcgctgcgcagcaggtagcccttgatgcagtgcggcagcgcgtcgtccgccagctggaagcagcgcccgtccaccagcacgaacagccggtgcgcct

SEQ ID NO: 54 - protein, 280 aa, Homo sapiens
MCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVRALLPEETPAAVLSSAENIAVGLATEKACAWLSANITALIRREVKAAVSRTLRAQGPEPAARGERRGCSRA

SEQ ID NO: 55 - DNA, 2401 bp, Homo sapiens
tcccttgacaggtctggtggctggttcggggtctactgaaggctgtcttgatcaggaaactgaagactctctgcttttgccacagcagttcctgcagcttccttgaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggaaaaaaaaaaaaaaaaaaaaaaaaaaaaaaaaaaaaaaaa

SEQ ID NO: 56 - protein, 299 aa, Homo sapiens
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 57 - DNA, 4277 bp, Homo sapiens
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaactagaagaagtggagtgttgccagggacggcagtatctctttgtgtgaccctggcggcctatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgaagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaagcaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaaa

SEQ ID NO: 58 - protein, 1115 aa, Homo sapiens [sequence omitted]

SEQ ID NO: 59 - DNA, 25 bp, Artificial Sequence
  Synthetic oligonucleotide probe
gggaaacacagcagtcattgcctgc

SEQ ID NO: 60 - DNA, 24 bp, Artificial Sequence
  Synthetic oligonucleotide probe
gcacacgtagcctgtcgctggagc

SEQ ID NO: 61 - DNA, 42 bp, Artificial Sequence
  Synthetic oligonucleotide probe
caccccaaagcccaggtccggtacagcgtcaaacaagagtgg

SEQ ID NO: 62 - DNA, 1661 bp, Homo sapiens
  unsure 678: unknown base
cgggaggctgggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgctgcggcagcccgtaacccgcgcggagaccacgccgggcgcccccagagccctctccacgctgggctcccccagcctcttcaccacgccgggtgtccccagcgccctcactaccccaggcctcactacgccaggcacccccaaaaccctggaccttcggggtcgcgcgcaggccctgatgcggagtttcccactcgtggacggccacaatgacctgccccaggtcctgagacagcgttacaagaatgtgcttcaggatgttaacctgcgaaatttcagccatggtcagaccagcctggacaggcttagagacggcctcgtgggtgcccagttctggtcagcctccgtctcatgccagtcccaggaccagactgccgtgcgcctcgccctggagcagattgacctcattcaccgcatgtgtgcctcctactctgaactcgagcttgtgacctcagctgaaggtctgaacagctctcaaaagctggcctgcctcattggcgtgnagggtggtcactcactggacagcagcctctctgtgctgcgcagtttctatgtgctgggggtgcgctacctgacacttaccttcacctgcagtacaccatgggcagagagttccaccaagttcagacaccacatgtacaccaacgtcagcggattgacaagctttggtgagaaagtagtagaggagttgaaccgcctgggcatgatgatagatttgtcctatgcatcggacaccttgataagaagggtcctggaagtgtctcaggctcctgtgatcttctcccactcagctgccagagctgtgtgtgacaatttgttgaatgttcccgatgatatcctgcagcttctgaagaacggtggcatcgtgatggtgacactgtccatgggggtgctgcagtgcaacctgcttgctaacgtgtccactgtggcagatcactttgaccacatcagggcagtcattggatctgagttcatcgggattggtggaaattatgacgggactggccggttccctcaggggctggaggatgtgtccacatacccagtcctgatagaggagttgctgagtcgtasctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcatatgctgagaataaacatgttacacatggaaaa

SEQ ID NO: 63 - protein, 487 aa, Homo sapiens
  unsure 196, 386: unknown amino acid
MQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVXGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKNGGIVMVTLSMGVLQCNLLANVSTVADHFDHIRAVIGSEFIGIGGNYDGTGRFPQGLEDVSTYPVLIEELLSRXWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 64 - DNA, 25 bp, Artificial Sequence
  Synthetic oligonucleotide probe
ccttcacctgcagtacaccatgggc

SEQ ID NO: 65 - DNA, 25 bp, Artificial Sequence
  Synthetic oligonucleotide probe
gtcacacacagctctggcagctgag

SEQ ID NO: 66 - DNA, 47 bp, Artificial Sequence
  Synthetic oligonucleotide probe
ccaagttcagacaccacatgtacaccaacgtcagcggattgacaagc

SEQ ID NO: 67 - DNA, 1564 bp, Homo sapiens
tgctaggctctgtcccacaatgcacccgagagcaggagctgaaagcctctaacacccacagatccctctatgactgcaatgtgaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccggcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 68 - protein, 183 aa, Homo sapiens
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 69 - DNA, 3170 bp, Homo sapiens
agcgggtctcgcttgggttccgctaatttctgtcctgaggcgtgagactgagttcatagggtcctgggtccccgaaccaggaagggttgagggaacacaatctgcaagcccccgcgacccaagtgaggggccccgtgttggggtcctccctccctttgcattcccacccctccgggctttgcgtcttcctggggaccccctcgccgggagatggccgcgttgatgcggagcaaggattcgtcctgctgcctgctcctactggccgcggtgctgatggtggagagctcacagatcggcagttcgcgggccaaactcaactccatcaagtcctctctgggcggggagacgcctggtcaggccgccaatcgatctgcgggcatgtaccaaggactggcattcggcggcagtaagaagggcaaaaacctggggcaggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgcaacttgtctatgtaaataatgtacacatttgtggaaaatgctattattaagagaacaagcacacagtggaaattactgatgagtagcatgtgactttccaagagtttaggttgtgctggaggagaggtttccttcagattgctgattgcttatacaaataacctacatgccagatttctattcaacgttagagtttaacaaaatactcctagaataacttgttatacaataggttctaaaaataaaattgctaaacaagaaatgaaaacatggagcattgttaatttacaacagaaaattaccttttgatttgtaacactacttctgctgttcaatcaagagtcttggtagataagaaaaaaatcagtcaatatttccaaataattgcaaaataatggccagttgtttaggaaggcctttaggaagacaaataaataacaaacaaacagccacaaatacttttttttcaaaattttagttttacctgtaattaataagaactgatacaagacaaaaacagttccttcagattctacggaatgacagtatatctctctttatcctatgtgattcctgctctgaatgcattatattttccaaactatacccataaattgtgactagtaaaatacttacacagagcagaattttcacagatggcaaaaaaatttaaagatgtccaatatatgtgggaaaagagctaacagagagatcattatttcttaaagattggccataacctatattttgatagaattagattggtaaatacatgtattcatacatactctgtggtaatagagacttaagctggatctgtactgcactggagtaagcaagaaaattgggaaaactttttcgtttgttcaggttttggcaacacatagatcatatgtctgaggcacaagttggctgttcatctttgaaaccaggggatgcacagtctaaatgaatatctgcatgggatttgctatcataatatttactatgcagatgaattcagtgtgaggtcctgtgtccgtactatcctcaaattatttattttatagtgctgagatcctcaaataatctcaatttcaggaggtttcacaaaatgtactcctgaagtagacagagtagtgaggtttcattgccctctataagcttctgactagccaatggcatcatccaattttcttcccaaacctctgcagcatctgctttattgccaaagggctagtttcggttttctgcagccattgcggttaaaaaatataagtaggataacttgtaaaacctgcatattgctaatctatagacaccacagtttctaaattctttgaaaccactttactactttttttaaacttaactcagttctaaatactttgtctggagcacaaaacaataaaaggttatcttatagtcgtgactttaaacttttgtagaccacaattcactttttagttttcttttacttaaatcccatctgcagtctcaaatttaagttctcccagtagagattgagtttgagcctgtatatctattaaaaatttcaacttcccacatatatttactaagatgattaagacttacattttctgcacaggtctgcaaaaacaaaaattataaactagtccatccaagaaccaaagtttgtataaacaggttgctataagcttgtgaaatgaaaatggaacatttcaatcaaacatttcctatataacaattattatatttacaatttggtttctgcaatatttttcttatgtccacccttttaaaaattattatttgaagtaatttatttacaggaaatgttaatgagatgtattttcttatagagatatttcttacagaaagctttgtagcagaatatatttgcagctattgactttgtaatttaggaaaaatgtataataagataaaatctattaaatttttctcctctaaaaactgaaaaaaaaaaaaaaaaaaaaaaaaaaaaaaa

SEQ ID NO: 70 - protein, 259 aa, Homo sapiens
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 71 - DNA, 1809 bp, Homo sapiens
tctcaatctgctgacctcgtgatccgcctgaccttgtaatccacctaccttggcctcccaaagtgttgggattacaggcgtgagccaccgcgcccggccaacatcacgtttttaaaaattgatttcttcaaattcatggcaaatatttcccttccctttaacttcttatgtcagaatgaggaaggatagctgcatttatttagtcagttttcattgcatagtaatattttcatgtagtattttctaagttatattttagtaattcatatgttttagattataggttttaacatacttgtgaaaatacttgatgtgttttaaagccttgggcagaaattctgtattgttgaggatttgttcttttatcccccttttaaagtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacagtaagtatagcagcaagctactcttgtcatggctggtgccaaccaaacagaggaagaggatagctcacgtgatgtggaaaacaccagttggtcaatggctcattcgttaaaaagcagcccttttgcttttttgtttttggaccaggtgttggctgtggtgttattagaaatgtcttaaccacagcaagaaggaggtggtggtctcatattcttctgccctaatcagactgcaccacaagtgcagcatacagtatgcattttaaagatgcttgggccaggcggggtggctgatgcccataatcccagtgctttggggggccaaggcaggcagattgcccaagctcaggagtttgagaccaccctgggcaacatggtgaaactctgtctctactaaaatacgaaaaactagccgggtgtggtggcggcgcgtgcctgtaatcccagctacttgggaggctgaggcacaagaatcgcttgagccagcttgggctacaaagtgagactccgtctgaaaaga

SEQ ID NO: 72 - protein, 363 aa, Homo sapiens
MCFKALGRNSVLLRICSFIPLLKSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDSKYSSKLLLSWLVPTKQRKRIAHVMWKTPVGQWLIR

SEQ ID NO: 73 - DNA, 26 bp, Artificial Sequence
  Synthetic oligonucleotide probe
aattcatggcaaatatttcccttccc

SEQ ID NO: 74 - DNA, 22 bp, Artificial Sequence
  Synthetic oligonucleotide probe
tggtaaactggcccaaactcgg

SEQ ID NO: 75 - DNA, 50 bp, Artificial Sequence
  Synthetic oligonucleotide probe
ttaaagtcatccgtccttggctcaggatttggagagcttgcaccaccaaa

SEQ ID NO: 76 - DNA, 1989 bp, Homo sapiens
gccgagtgggacaaagcctggggctgggcgggggccatggcgctgccatcccgaatcctgctttggaaacttgtgcttctgcagagctctgctgttctcctgcactcagcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgatttttaaaaaaaaaaaaaaa

SEQ ID NO: 77 - protein, 341 aa, Homo sapiens
MALPSRILLWKLVLLQSSAVLLHSAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 78 - DNA, 2243 bp, Homo sapiens
cgccggaggcagcggcggcgtggcgcagcggcgacatggccgttgtctcagaggacgactttcagcacagttcaaactccacctacggaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacacttcctcctggacccgtggtttttttgcggtcaccattgtctgcatggtgatcctcagcggtgcctccactgtcttcagcagcagcatctacggcatgaccggctcctttcctatgaggaactcccaagcactgatatcaggaggagccatgggcgggacggtcagcgccgtggcctcattggtggacttggctgcatccagtgatgtgaggaacagcgccctggccttcttcctgacggccaccatcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccgtctgcaccaacatcgagtccctcaacaagggctcgggctcactgtggaccaccaagtttttcatccccctcactaccttcctcctgtacaactttgctgacctatgtggccggcagctcaccgcctggatccaggtgccagggcccaacagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgcgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaaaaa

SEQ ID NO: 79 - protein, 475 aa, Homo sapiens
MAVVSEDDFQHSSNSTYGTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATIFLVLCMGLYLLLSRLEYARYYMRPVLAAHVFSGEEELPQDSLSAPSVASRFIDSHTPPLRPILKKTASLGFCVTYVFFITSLIYPAVCTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 80 - DNA, 22 bp, Artificial Sequence
  Synthetic oligonucleotide probe
ttttgcggtcaccattgtctgc

SEQ ID NO: 81 - DNA, 23 bp, Artificial Sequence
  Synthetic oligonucleotide probe
cgtaggtgacacagaagcccagg

SEQ ID NO: 82 - DNA, 49 bp, Artificial Sequence
  Synthetic oligonucleotide probe
tacggcatgaccggctcctttcctatgaggaactcccaggcactgatat

SEQ ID NO: 83 - DNA, 1844 bp, Homo sapiens
gacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaaaaaaaaaaaaaaaaaaaaaaaaaaaaaaaaaaaaaaaaaaaaa

SEQ ID NO: 84 - protein, 567 aa, Homo sapiens
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 85 - DNA, 3316 bp, Homo sapiens
ctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatactgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagataaaaaa

SEQ ID NO: 86 - protein, 739 aa, Homo sapiens
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 87 - DNA, 2725 bp, Homo sapiens
ggaggcggaggccgcggcgagccgggccgagcagtgagggccctagcggggcccgagcggggcccggggcccctaagccattcctgaagtcatgggctggccaggacattggtgacccgccaatccggtatggacgactggaagcccagccccctcatcaagccctttggggctcggaagaagcggagctggtaccttacctggaagtataaactgacaaaccagcgggccctgcggagattctgtcagacaggggccgtgcttttcctgctggtgactgtcattgtcaatatcaagttgatcctggacactcggcgagccatcagtgaagccaatgaagacccagagccagagcaagactatgatgaggccctaggccgcctggagcccccacggcgcagaggcagtggtccccggcgggtcctggacgtagaggtgtattcaagtcgcagcaaagtatatgtggcagtggatggcaccacggtgctggaggatgaggcccgggagcagggccggggcatccatgtcattgtcctcaaccaggccacgggccacgtgatggcaaaacgtgtgtttgacacgtactcacctcatgaggatgaggccatggtgctattcctcaacatggtagcgcccggccgagtgctcatctgcactgtcaaggatgagggctccttccacctcaaggacacagccaaggctctgctgaggagcctgggcagccaggctggccctgccctgggctggagggacacatgggccttcgtgggacgaaaaggaggtcctgtcttcggggagaaacattctaagtcacctgccctctcttcctggggggacccagtcctgctgaagacagatgtgccattgagctcagcagaagaggcagagtgccactgggcagacacagagctgaaccgtcgccgccggcgcttctgcagcaaagttgagggctatggaagtgtatgcagctgcaaggaccccacacccatcgagttcagccctgacccactcccagacaacaaggtcctcaatgtgcctgtggctgtcattgcagggaaccgacccaattacctgtacaggatgctgcgctctctgctttcagcccagggggtgtctcctcagatgataacagttttcattgacggctactatgaggaacccatggatgtggtggcactgtttggtctgaggggcatccagcatactcccatcagcatcaagaatgcccgcgtgtctcagcactacaaggccagcctcactgccactttcaacctgtttccggaggccaagtttgctgtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagagtgcatcatccctgacgtttcccgatcctaccactttggcatcgtcggcctcaacatgaatggctactttcacgaggcctacttcaagaagcacaagttcaacacggttccaggtgtccagctcaggaatgtggacagtctgaagaaagaagcttatgaagtggaagttcacaggctgctcagtgaggctgaggttctggaccacagcaagaacccttgtgaagactctttcctgccagacacagagggccacacctacgtggcctttattcgaatggagaaagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctgggaaaaaaaaaaaaaaaaaaaaaaaaaa

SEQ ID NO: 88 - protein, 660 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 89 - DNA, 25 bp, Artificial Sequence
  Synthetic oligonucleotide probe
gatggcaaaacgtgtgtttgacacg

SEQ ID NO: 90 - DNA, 22 bp, Artificial Sequence
  Synthetic oligonucleotide probe
cctcaaccaggccacgggccac

SEQ ID NO: 91 - DNA, 24 bp, Artificial Sequence
  Synthetic oligonucleotide probe
cccaggcagagatgcagtacaggc

SEQ ID NO: 92 - DNA, 26 bp, Artificial Sequence
  Synthetic oligonucleotide probe
cctccagtaggtggatggattggctc

SEQ ID NO: 93 - DNA, 47 bp, Artificial Sequence
  Synthetic oligonucleotide probe
ctcacctcatgaggatgaggccatggtgctattcctcaacatggtag

SEQ ID NO: 94 - DNA, 3037 bp, Homo sapiens
cggacgcgtgggctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtcaaaaaaaa

SEQ ID NO: 95 - protein, 307 aa, Homo sapiens
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 96 - DNA, 25 bp, Artificial Sequence
  Synthetic oligonucleotide probe
gttgtgggtgaataaaggagggcag

SEQ ID NO: 97 - DNA, 25 bp, Artificial Sequence
  Synthetic oligonucleotide probe
ctgtgctcatgttcatggacaactg

SEQ ID NO: 98 - DNA, 50 bp, Artificial Sequence
  Synthetic oligonucleotide probe
ggatgatttcatctccattagcctgctgtctctggctatgttggtgggat

SEQ ID NO: 99 - DNA, 1429 bp, Homo sapiens
gctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctga

SEQ ID NO: 100 - protein, 401 aa, Homo sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 101 - DNA, 3671 bp, Homo sapiens
ggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttatggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatat

SEQ ID NO: 102 - protein, 1089 aa, Homo sapiens
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 103 - DNA, 1743 bp, Homo sapiens
tgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatcacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgt

SEQ ID NO: 104 - protein, 442 aa, Homo sapiens
MSYNGLHQRVFKELKLLTLCSISSQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 105 - DNA, 21 bp, Artificial Sequence
  Synthetic oligonucleotide probe
cgctgctgctgttgctcctgg

SEQ ID NO: 106 - DNA, 18 bp, Artificial Sequence
  Synthetic oligonucleotide probe
cagtgtgccaggactttg

SEQ ID NO: 107 - DNA, 18 bp, Artificial Sequence
  Synthetic oligonucleotide probe
agtcgcaggcagcgttgg

SEQ ID NO: 108 - DNA, 25 bp, Artificial Sequence
  Synthetic oligonucleotide probe
ctcctccgagtctgtgtgctcctgc

SEQ ID NO: 109 - DNA, 51 bp, Artificial Sequence
  Synthetic oligonucleotide probe
ggacgggcagttccctgtgtctctggtggtttgcctaaacctgcaaacatc

SEQ ID NO: 110 - DNA, 1114 bp, Homo sapiens
cggacgcgtgggcggacgcgtgggcggacgcgtgggtctctgcggggagacgccagcctgcgtctgccatggggctcgggttgaggggctggggacgtcctctgctgactgtggccaccgccctgatgctgcccgtgaagccccccgcaggctcctggggggcccagatcatcgggggccacgaggtgaccccccactccaggccctacatggcatccgtgcgcttcgggggccaacatcactgcggaggcttcctgctgcgagcccgctgggtggtctcggccgcccactgcttcagccacagagacctccgcactggcctggtggtgctgggcgcccacgtcctgagtactgcggagcccacccagcaggtgtttggcatcgatgctctcaccacgcaccccgactaccaccccatgacccacgccaacgacatctgcctgctgcggctgaacggctctgctgtcctgggccctgcagtggggctgctgaggctgccagggagaagggccaggccccccacagcggggacacggtgccgggtggctggctggggcttcgtgtctgactttgaggagctgccgcctggactgatggaggccaaggtccgagtgctggacccggacgtctgcaacagctcctggaagggccacctgacacttaccatgctctgcacccgcagtggggacagccacagacggggcttctgctcggccgactccggagggcccctggtgtgcaggaaccgggctcacggcctcgtttccttctcgggcctctggtgcggcgaccccaagacccccgacgtgtacacgcaggtgtccgcctttgtggcctggatctgggacgtggttcggcggagcagtccccagcccggccccctgcctgggaccaccaggcccccaggagaagccgcctgagccacaaccttgcggcatgcaaatgagatggccgctccaggcctggaatgttccgtggctgggccccacgggaagcctgatgttcagggttggggtgggacgggcagcggtggggcacacccattccacatgcaaagggcagaagcaaacccagtaaaatgttaactgacaaaaaaaaaaaaaaaaaaaagaaa

SEQ ID NO: 111 - protein, 283 aa, Homo sapiens
MGLGLRGWGRPLLTVATALMLPVKPPAGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRLPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 112 - DNA, 24 bp, Artificial Sequence
  Synthetic oligonucleotide probe
gacgtctgcaacagctcctggaag

SEQ ID NO: 113 - DNA, 23 bp, Artificial Sequence
  Synthetic oligonucleotide probe
cgagaaggaaacgaggccgtgag

SEQ ID NO: 114 - DNA, 44 bp, Artificial Sequence
  Synthetic oligonucleotide probe
tgacacttaccatgctctgcacccgcagtggggacagccacaga

SEQ ID NO: 115 - DNA, 1808 bp, Homo sapiens
gagctacccaggcggctggtgtgcagcaagctccgcgccgactccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccccgggctctggctggttccgtctgctctgctgccagcaggggagaggggccatctgatgcttcccctgggaatctaaactgggaatggccgaggaggaaggggctctgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcccgagttcaggctctgcacggcatggagtgggaaccccaccagctgctgctacaggacctgggattgcctgggactcccaccttcctatcaattctcatggtagtccaaactgcagactctcaaacttgctcattt

SEQ ID NO: 116 - protein, 331 aa, Homo sapiens
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 117 - DNA, 2249 bp, Homo sapiens
gaagttcgcgagcgctggcatgtggtcctggggcgcggctggcggcgctgctggcggtgctggcgctcgggacaggagacccagaaagggctgcggctcggggcgacacgttctcggcgctgaccagcgtggcgcgcgccctggcgcccgagcgccggctgctggggctgctgaggcggtacctgcgcggggaggaggcgcggctgcgggacctgactagattctacgacaaggtactttctttgcatgaggattcaacaacccctgtggctaaccctctgcttgcatttactctcatcaaacgcctgcagtctgactggaggaatgtggtacatagtctggaggccagtgagaacatccgagctctgaaggatggctatgagaaggtggagcaagaccttccagcctttgaggaccttgagggagcagcaagggccctgatgcggctgcaggacgtgtacatgctcaatgtgaaaggcctggcccgaggtgtctttcagagagtcactggctctgccatcactgacctgtacagccccaaacggctcttttctctcacaggggatgactgcttccaagttggcaaggtggcctatgacatgggggattattaccatgccattccatggctggaggaggctgtcagtctcttccgaggatcttacggagagtggaagacagaggatgaggcaagtctagaagatgccttggatcacttggcctttgcttatttccgggcaggaaatgtttcgtgtgccctcagcctctctcgggagtttcttctctacagcccagataataagaggatggccaggaatgtcttgaaatatgaaaggctcttggcagagagccccaaccacgtggtagctgaggctgtcatccagaggcccaatataccccacctgcagaccagagacacctacgaggggctatgtcagaccctgggttcccagcccactctctaccagatccctagcctctactgttcctatgagaccaattccaacgcctacctgctgctccagcccatccggaaggaggtcatccacctggagccctacattgctctctaccatgacttcgtcagtgactcagaggctcagaaaattagagaacttgcagaaccatggctacagaggtcagtggtggcatcaggggagaagcagttacaagtggagtaccgcatcagcaaaagtgcctggctgaaggacactgttgacccaaaactggtgaccctcaaccaccgcattgctgccctcacaggccttgatgtccggcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatcaaaa

SEQ ID NO: 118 - protein, 544 aa, Homo sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 119 - DNA, 23 bp, Artificial Sequence
  Synthetic oligonucleotide probe
cgggacaggagacccagaaaggg

SEQ ID NO: 120 - DNA, 24 bp, Artificial Sequence
  Synthetic oligonucleotide probe
ggccaagtgatccaaggcatcttc

SEQ ID NO: 121 - DNA, 49 bp, Artificial Sequence
  Synthetic oligonucleotide probe
ctgcgggacctgactagattctacgacaaggtactttctttgcatgggg

SEQ ID NO: 122 - DNA, 1778 bp, Homo sapiens
gagatagggagtctgggtttaagttcctgctccatctcaggagcccctgctcccacccctaggaagccaccagactccacggtgtggggccaatcaggtggaatcggccctggcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgtgcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttttacgtgatttttgtaacattcatttttttgtacagataacaggagtttctgactaatcaaagctggtatttccccgcatgtcttattcttgcccttcccccaaccagtttgttaatcaaacaataaaaacatgttttgttttgtttttaaaaaaaaa

SEQ ID NO: 123 - protein, 294 aa, Homo sapiens [sequence omitted]

SEQ ID NO: 124 - DNA, 25 bp, Artificial Sequence
  Synthetic oligonucleotide probe
atcatctattccaccgtgttctggc

SEQ ID NO: 125 - DNA, 25 bp, Artificial Sequence
  Synthetic oligonucleotide probe
gacagagtgctccatgatgatgtcc

SEQ ID NO: 126 - DNA, 50 bp, Artificial Sequence
  Synthetic oligonucleotide probe
cctgtctgtgggcatctatgcagaggttgagcggcagaaatataaaaccc

SEQ ID NO: 127 - DNA, 1636 bp, Homo sapiens
gaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgtataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccagctctcctgtctcccagtgaagacttggatggcagccatcagggaaggctgggtcccagctgggagtatgggtgtgagctctatagaccatccctctctgcaatcaataaacacttgcctgtgaaaaa

SEQ ID NO: 128 - protein, 484 aa, Homo sapiens [sequence omitted]

SEQ ID NO: 129 - DNA, 2213 bp, Homo sapiens
gagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccgagatcacgccactgcactccagcctggcaacagagcgagactccatctcaaaaaaaaaaaaaa

SEQ ID NO: 130 - protein, 335 aa, Homo sapiens
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 131 - DNA, 2476 bp, Homo sapiens
aagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaataaaaataaaataataataattaccaatttttcattattttgtaagaatgtagtgtattttaagataaaatgccaatgattataaaatcacatattttcaaaaatggttattatttaggcctttgtacaatttctaacaatttagtggaagtatcaaaaggattgaagcaaatactgtaacagttatgttcctttaaataatagagaatataaaatattgtaataatatgtatcataaaatagttgtatgtgagcatttgatggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 132 - protein, 536 aa, Homo sapiens
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 133 - DNA, 1475 bp, Homo sapiens
gagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaata

SEQ ID NO: 134 - protein, 230 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 135 - DNA, 610 bp, Homo sapiens
gcactgctgctgtcccatcagctgctctgaagctccatggtgcccagaatcttcgctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctaaggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtacacacctgtaaaa

SEQ ID NO: 136 - protein, 119 aa, Homo sapiens
MVPRIFAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 137 - DNA, 771 bp, Homo sapiens
ctccactgcaaccacccagagccatggctccccgaggctgcatcgtagctgtctttgccattttctgcatctccaggctcctctgctcacacggagccccagtggcccccatgactccttacctgatgctgtgccagccacacaagagatgtggggacaagttctacgaccccctgcagcactgttgctatgatgatgccgtcgtgcccttggccaggacccagacgtgtggaaactgcaccttcagagtctgctttgagcagtgctgcccctggaccttcatggtgaagctgataaaccagaactgcgactcagcccggacctcggatgacaggctttgtcgcagtgtcagctaatggaacatcaggggaacgatgactcctggattctccttcctgggtgggcctggagaaagaggctggtgttacctgagatctgggatgctgagtggctgtttgggggccagagaaacacacactcaactgcccacttcattctgtgacctgtctgaggcccaccctgcagctgccctgaggaggcccacaggtccccttctagaattctggacagcatgagatgcgtgtgctgatgggggcccagggactctgaaccctcctgatgacccctatggccaacatcaacccggcaccaccccaaggctggctggggaacccttcacccttctgtgagattttccatcatctcaagttctcttctatccaggagcaaagcacaggatcataataaatttatgtactttataaatgaaaa

SEQ ID NO: 138 - protein, 110 aa, Homo sapiens
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 139 - DNA, 2044 bp, Homo sapiens
gggggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaaaaaaaaaaaaaaaaaaaaaaaaaaaaaaaaaaaaga

SEQ ID NO: 140 - protein, 311 aa, Homo sapiens
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 141 - DNA, 1732 bp, Homo sapiens
cccacgcgtccgcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccactgccagactcctgctgccaagcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctcaaaaaaaaaaaaaaaaaaaaaa

SEQ ID NO: 142 - protein, 451 aa, Homo sapiens
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDEETEAQRGEVPGPRPHSQNLPLDSDQESQEARLPERGTALPTARWPPRRSLERLPSPDPGAEGHGQSRQSDQDITKT

SEQ ID NO: 143 - DNA, 693 bp, Homo sapiens
ctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaaaaaaaaaaaaaaaaaaaaaaaaaaaaaaaaaaaaaaaaaaaaaaaaaaaaaaaaaaaaa

SEQ ID NO: 144 - protein, 93 aa, Homo sapiens [sequence omitted]

SEQ ID NO: 145 - DNA, 1883 bp, Homo sapiens
caggagagaaggcaccgcccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggtagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccacaaaaaaaaaaaaaaaaaaaaaaaaaaaaaaaaaaaaaaaaaaaaaaaaaaaaaaaaaaaaaaaaaaaaaaaaa

SEQ ID NO: 146 - protein, 406 aa, Homo sapiens [sequence omitted]

SEQ ID NO: 147 - DNA, 2052 bp, Homo sapiens
gacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaaaaaa

SEQ ID NO: 148 - protein, 500 aa, Homo sapiens
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 149 - DNA, 24 bp, Artificial Sequence
  Synthetic oligonucleotide probe
gcgtggtccacctctacagggacg

SEQ ID NO: 150 - DNA, 23 bp, Artificial Sequence
  Synthetic oligonucleotide probe
ggaactgacccagtgctgacacc

SEQ ID NO: 151 - DNA, 45 bp, Artificial Sequence
  Synthetic oligonucleotide probe
gcagatgccacagtatcaaggcaggacaaaactggtgaaggattc

SEQ ID NO: 152 - DNA, 2294 bp, Homo sapiens
gcgatggtgcgcccggtggcggtggcggcggcggttgcggaggcttccttggtcggattgcaacgaggagaagatgactgaccaaccgactggctgaatgaatgaatggcggagccgagcgcgccatgaggagcctgccgagcctgggcggcctcgccctgttgtgctgcgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacaggtaagcaacagagggtggaactgaagtttattttattttagcaagggaaaaaaaaaggctgctactctcaaggaccatactggtttaaacaaaggaggatgagggtcatagatttacaaaatattttatatacttttattctcttactttatatgttatatttaatgtcaggatttaaaaacatctaatttactgatttagttcttcaaaagcactagagtcgccaatttttctctgggataatttctgtaaatttcatgggaaaaaattattgaagaataaatctgctttctggaagggctttcaggcatgaaacctgctaggaggtttagaaatgttcttatgtttattaatataccattggagtttgaggaaatttgttgtttggtttatttttctctctaatcaaaattctacatttgtttctttggacatctaaagcttaacctgggggtaccctaatttatttaactagtggtaagtagactggttttactctatttaccagtacatttttgagaccaaaagtagattaagcaggaattatctttaaactattatgttatttggaggtaatttaatctagtggaataatgtactgttatctaagcatttgccttgtactgcactgaaagtaattattctttgaccttatgtgaggcacttggctttttgtggaccccaagtcaaaaaactgaagagacagtattaaataatgaaaaaaataatgacaggttatactcagtgtaacctgggtataacccaagatctgctgccacttacgagctgtgttccttgggcaagtaatttcctttcactgagcttgtttcttctcaaggttgttgtgaagattaaatgagttgatatatataaaatgcctagcacatgtcactcaataaattctggtttgttttaatttcaaaggaatattatggactgaaatgagagaacatgttttaagaacttttagctccttgacaaagaagtgctttatactttagcactaaatattttaaatgctttataaatgatattatactgttatggaatattgtatcatattgtagtttattaaaaatgtagaagaggctgggcgcggtggctcacgcctgtaatcctagcactttgggaggccaaggcgggtggatcacttgaggccaggagttctagatgagcctggccagcacagtgaaaccccgtctctactaaaaatacaaacaaattagctgggcgtggtggcacacacctgtagtcccagctactcgggaggctgaggcaggagaatcggttgaacccgggaggtggaggttgcagtgagctgagatcgcgccactgcactccagcctggtgagagagggagactctgtcttaaaaaaaaaaaaaaaaaaaaaaaaaa

SEQ ID NO: 153 - protein, 258 aa, Homo sapiens
MRSLPSLGGLALLCCAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNR

SEQ ID NO: 154 - DNA, 24 bp, Artificial Sequence
  Synthetic oligonucleotide probe
aactgctctgtggttggaagcctg

SEQ ID NO: 155 - DNA, 24 bp, Artificial Sequence
  Synthetic oligonucleotide probe
cagtcacatggctgacagacccac

SEQ ID NO: 156 - DNA, 38 bp, Artificial Sequence
  Synthetic oligonucleotide probe
aggttatcaggggcttcactgtgaaacctgcaaagagg

SEQ ID NO: 157 - DNA, 689 bp, Homo sapiens
tgcggcgcagtgtagacctgggaggatgggcggcctgctgctggctgcttttctggctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagca

SEQ ID NO: 158 - protein, 163 aa, Homo sapiens
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 159 - DNA, 1665 bp, Homo sapiens
aacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctacccgcctcagaacttgaccatgactgtcttccaaggagacggcacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagcaaagccacatcaggagtgactcagggggtggtcgggggagctggagccacagccctggtcttcctgtccttctgcgtcatcttcgttgtagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattccta

SEQ ID NO: 160 - protein, 463 aa, Homo sapiens
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 161 - DNA, 739 bp, Homo sapiens
gacgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggatcggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcccggaccacctggacctaccctccagccatgacccttccctgctcccacccacctgactccaaataaagtccttttcccccaaaaaaaaaaaaaaaaaaaaaaaaaaaaaaaaaaaaaaaaaaaaaaaaa

SEQ ID NO: 162 - protein, 170 aa, Homo sapiens
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 163 - DNA, 22 bp, Artificial Sequence
  Synthetic oligonucleotide probe
ggagatgaagaccctgttcctg

SEQ ID NO: 164 - DNA, 26 bp, Artificial Sequence
  Synthetic oligonucleotide probe
ggagatgaagaccctgttcctgggtg

SEQ ID NO: 165 - DNA, 21 bp, Artificial Sequence
  Synthetic oligonucleotide probe
gtcctccggaaagtccttatc

SEQ ID NO: 166 - DNA, 25 bp, Artificial Sequence
  Synthetic oligonucleotide probe
gcctagtgttcgggaacgcagcttc

SEQ ID NO: 167 - DNA, 50 bp, Artificial Sequence
  Synthetic oligonucleotide probe
cagggacctggtacgtgaaggccatggtggtcgataaggactttccggag

SEQ ID NO: 168 - DNA, 45 bp, Artificial Sequence
  Synthetic oligonucleotide probe
ctgtccttcaccctggaggaggaggatatcacagggacctggtac

SEQ ID NO: 169 - DNA, 1204 bp, Homo sapiens
gttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgaaaaaaaaaaaaaaaaaaaaaaaaaaaaaaaaaaaaaa

SEQ ID NO: 170 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 171 - DNA, 25 bp, Artificial Sequence
  Synthetic oligonucleotide probe
ggctgcgggactggaagtcatcggg

SEQ ID NO: 172 - DNA, 24 bp, Artificial Sequence
  Synthetic oligonucleotide probe
ctccaggccatgaggattctgcag

SEQ ID NO: 173 - DNA, 18 bp, Artificial Sequence
  Synthetic oligonucleotide probe
cctctggtctgtaaccag

SEQ ID NO: 174 - DNA, 24 bp, Artificial Sequence
  Synthetic oligonucleotide probe
tctgtgatgttgccggggtaggcg

SEQ ID NO: 175 - DNA, 25 bp, Artificial Sequence
  Synthetic oligonucleotide probe
cgtgtagacaccaggctttcgggtg

SEQ ID NO: 176 - DNA, 18 bp, Artificial Sequence
  Synthetic oligonucleotide probe
cccttgatgatcctggtc

SEQ ID NO: 177 - DNA, 50 bp, Artificial Sequence
  Synthetic oligonucleotide probe
aggccatgaggattctgcagttaatcctgcttgctctggcaacagggctt

SEQ ID NO: 178 - DNA, 43 bp, Artificial Sequence
  Synthetic oligonucleotide probe
gagagaccaggatcatcaaggggttcgagtgcaagcctcactc

SEQ ID NO: 179 - DNA, 907 bp, Homo sapiens
gagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaaaaaaaaaaaaaaaaaaaaaaaaaaaaaaaaaaaaaaaaaaaaaaa

SEQ ID NO: 180 - protein, 222 aa, Homo sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 181 - DNA, 22 bp, Artificial Sequence
  Synthetic oligonucleotide probe
gtgttctgctggagccgatgcc

SEQ ID NO: 182 - DNA, 18 bp, Artificial Sequence
  Synthetic oligonucleotide probe
gacatggacaatgacagg

SEQ ID NO: 183 - DNA, 18 bp, Artificial Sequence
  Synthetic oligonucleotide probe
cctttcaggatgtaggag

SEQ ID NO: 184 - DNA, 18 bp, Artificial Sequence
  Synthetic oligonucleotide probe
gatgtctgccaccccaag

SEQ ID NO: 185 - DNA, 27 bp, Artificial Sequence
  Synthetic oligonucleotide probe
gcatcctgatatgacttgtcacgtggc

SEQ ID NO: 186 - DNA, 24 bp, Artificial Sequence
  Synthetic oligonucleotide probe
tacaagagggaagaggagttgcac

SEQ ID NO: 187 - DNA, 52 bp, Artificial Sequence
  Synthetic oligonucleotide probe
gcccattatgacggctacctggctaaagacggctcgaaattctactgcagcc

SEQ ID NO: 188 - DNA, 573 bp, Homo sapiens
cagaaatgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgccaggcatggtggctcgcgcctgtaatcccagttctttgggaagccaaggcaggtggatcacctgaggtcaggagtttgagaccagcctggccaacatagtgaaaccccgtgtctactaaaaatacaaaaatcagccgggcgtggtggtgcatgcctgcaatcccagttactcgggaggctgaggcaggagaatcgcttgaactcaggaggcagaagttgcagtgaacccagatcctgccattgcactccagcatggatgacagagcaagactccgtctcaaaaagaaaagatagtttcttgtttcatttcgcgactgccctctcagtgtttcctgggatcccctcccaaataaagtacttatattctc

SEQ ID NO: 189 - protein, 74 aa, Homo sapiens
MQGPLLLPGLCFLLSLFGAVTQKTKTSCAKCPPNASCVNNTHCTCNHGYTSGSGQKLFTFPLETCNARHGGSRL

SEQ ID NO: 190 - DNA, 24 bp, Artificial Sequence
  Synthetic oligonucleotide probe
agggaccattgcttcttccaggcc

SEQ ID NO: 191 - DNA, 24 bp, Artificial Sequence
  Synthetic oligonucleotide probe
cgttacatgtctccaaggggaatg

SEQ ID NO: 192 - DNA, 50 bp, Artificial Sequence
  Synthetic oligonucleotide probe
cctgtgctaagtgccccccaaatgcttcctgtgtcaataacactcactgc

SEQ ID NO: 193 - DNA, 1091 bp, Homo sapiens
caagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggcaaaaaaaaaaaaaa

SEQ ID NO: 194 - protein, 248 aa, Homo sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 195 - DNA, 1485 bp, Homo sapiens
gcggccacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaaaaaaaaaaaaaaaaa

SEQ ID NO: 196 - protein, 150 aa, Homo sapiens
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 197 - DNA, 4842 bp, Homo sapiens
cgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctctactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcagctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgaccaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttaaaaaaaaaaaaaaaaaaaaaaaa

SEQ ID NO: 198 - protein, 1523 aa, Homo sapiens [sequence omitted]

SEQ ID NO: 199 - DNA, 24 bp, Artificial Sequence
  Synthetic oligonucleotide probe
atggagattcctgccaacttgccg

SEQ ID NO: 200 - DNA, 24 bp, Artificial Sequence
  Synthetic oligonucleotide probe
ttgttggcattgaggaggagcagc

SEQ ID NO: 201 - DNA, 50 bp, Artificial Sequence
  Synthetic oligonucleotide probe
gagggcatcgtcgaaatacgcctagaacagaactccatcaaagccatccc

SEQ ID NO: 202 - DNA, 753 bp, Homo sapiens
ggatgcaggacgctcccctgagctgcctgtcaccgactaggtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagccccgacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattggcaaggctggaagaaacattgtgagggcagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtc

SEQ ID NO: 203 - protein, 148 aa, Homo sapiens
MKAAGILTLIGCLVTGAESKIYTRCKLAKIFSRAGLDNYWGFSLGNWICMAYYESGYNTTAPTVLDDGSIDYGIFQINSFAWCRRGKLKENNHCHVACSALITDDLTDAIICARKIVKETQGMNYWQGWKKHCEGRDLSEWKKGCEVS

SEQ ID NO: 204 - DNA, 24 bp, Artificial Sequence
  Synthetic oligonucleotide probe
gcaggctttgaggatgaaggctgc

SEQ ID NO: 205 - DNA, 24 bp, Artificial Sequence
  Synthetic oligonucleotide probe
ctcattggctgcctggtcacaggc

SEQ ID NO: 206 - DNA, 24 bp, Artificial Sequence
  Synthetic oligonucleotide probe
ccagtcggacaggtctctcccctc

SEQ ID NO: 207 - DNA, 24 bp, Artificial Sequence
  Synthetic oligonucleotide probe
tcagtgaccaaggctgagcaggcg

SEQ ID NO: 208 - DNA, 47 bp, Artificial Sequence
  Synthetic oligonucleotide probe
ctacactcgttgcaaactggcaaaaatattctcgagggctggcctgg

SEQ ID NO: 209 - DNA, 1648 bp, Homo sapiens
caggccatttgcatcccactgtccttgtgttcggagccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaaaaaaaaaaaaaaa

SEQ ID NO: 210 - protein, 323 aa, Homo sapiens
MPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 211 - DNA, 1554 bp, Homo sapiens
gactacgccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaa

SEQ ID NO: 212 - protein, 462 aa, Homo sapiens
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 213 - DNA, 759 bp, Homo sapiens
ctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattaaaaaaaaaaaa

SEQ ID NO: 214 - protein, 140 aa, Homo sapiens
MGRVSGLVPSRFLTLLAHLVVVITLFWSRDSNIQACLPLTFTPEEYDKQDIQLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 215 - DNA, 697 bp, Homo sapiens
tcccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctc

SEQ ID NO: 216 - protein, 196 aa, Homo sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 217 - DNA, 1871 bp, Homo sapiens
ctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctgagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggggca

SEQ ID NO: 218 - protein, 252 aa, Homo sapiens
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 219 - DNA, 2065 bp, Homo sapiens
gtgaatgtgagggtttgatgactttcagatgtctaggaaccagagtgggtgcaggggccccaggcagggctgattcttgggcggaggagagtagggtaaagggttctgcatgagctccttaaaggacaaaggtaacagagccagcgagagagctcgaggggagactttgacttcaagccacagaattggtggaagtgtgcgcgccgccgccgccgtcgctcctgcagcgctgtcgacctagccgctagcatcttcccgagcaccgggatcccggggtaggaggcgacgcgggcgagcaccagcgccagccggctgcggctgcccacacggctcaccatgggctccgggcgccgggcgctgtccgcggtgccggccgtgctgctggtcctcacgctgccggggctgcccgtctgggcacagaacgacacggagcccatcgtgctggagggcaagtgtctggtggtgtgcgactcgaacccggccacggactccaagggctcctcttcctccccgctggggatatcggtccgggcggccaactccaaggtcgccttctcggcggtgcggagcaccaaccacgagccatccgagatgagcaacaagacgcgcatcatttacttcgatcagatcctggtgaatgtgggtaattttttcacattggagtctgtctttgtagcaccaagaaaaggaatttacagtttcagttttcacgtgattaaagtctaccagagccaaactatccaggttaacttgatgttaaatggaaaaccagtaatatctgcctttgcgggggacaaagatgttactcgtgaagctgccacgaatggtgtcctgctctacctagataaagaggataaggtttacctaaaactggagaaaggtaatttggttggaggctggcagtattccacgttttctggctttctggtgttccccctataggattcaatttctccatgatgttcatccaggtgagggatgacccactcctgagttattggaagatcattttttcatcattggattgatgtcttttattggtttctcatgggtggatatggattctaaggattctagcctgtctgaaccaatacaaaatttcacagattatttgtgtgtgtctgtttcagtatatttggattgggactctaagcagataatacctatgcttaaatgtaacagtcaaaagctgtctgcaagacttattctgaatttcatttcctgggattactgaattagttacagatgtggaattttatttgtttagttttaaaagactggcaaccaggtctaaggattagaaaactctaaagttctgacttcaatcaacggttagtgtgatactgccaaagaactgtatactgtgttaatatattgattatatttgtttttattcctttggaattagtttgtttggttcttgtaaaaaacttggattttttttttcagtaactggtattatgttttctcttaaaataaggtaatgaatggcttgcccacaaatttaccttgactacgatatcatcgacatgacttctctcaaaaaaaaagaatgcttcatagttgtattttaattgtatatgtgaaagagtcatattttccaagttatattttctaagaagaagaatagatcataaatctgacaaggaaaaagttgcttacccaaaatctaagtgctcaatccctgagcctcagcaaaacagctcccctccgagggaaatcttatactttattgctcaactttaattaaaatgattgataataaccactttattaaaaacctaaggttttttttttttccgtagacatgaccactttattaactggtggtgggatgctgttgtttctaattatacctatttttcaaggcttctgttgtatttgaagtatcatctggttttgccttaactctttaaattgtatatatttatctgtttagctaatattaaattcaaatatcccatatctaaatttagtgcaatatcttgtcttttgtataggtcatatgaattcataaaattatttatgtctgttatagaataaagattaatatatgttaaaaaaa

SEQ ID NO: 220 - protein, 201 aa, Homo sapiens
MGSGRRALSAVPAVLLVLTLPGLPVWAQNDTEPIVLEGKCLVVCDSNPATDSKGSSSSPLGISVRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 221 - DNA, 20 bp, Artificial Sequence
  Synthetic oligonucleotide probe
acggctcaccatgggctccg

SEQ ID NO: 222 - DNA, 24 bp, Artificial Sequence
  Synthetic oligonucleotide probe
aggaagaggagcccttggagtccg

SEQ ID NO: 223 - DNA, 40 bp, Artificial Sequence
  Synthetic oligonucleotide probe
cgtgctggagggcaagtgtctggtggtgtgcgactcgaac

SEQ ID NO: 224 - DNA, 902 bp, Homo sapiens
cggtggccatgactgcggccgtgttcttcggctgcgccttcattgccttcgggcctgcgctcgccctttatgtcttcaccatcgccatcgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagata

SEQ ID NO: 225 - protein, 257 aa, Homo sapiens [sequence omitted]

SEQ ID NO: 226 - DNA, 3939 bp, Homo sapiens
cggcaaccagccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccagggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcaaaaaaaaaaaaaaa

SEQ ID NO: 227 - protein, 832 aa, Homo sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 228 - DNA, 2848 bp, Homo sapiens
gctcaagtgccctgccttgccccacccagcccagcctggccagagccccctggagaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggaaaaaaaaaaaaaaaaaaaaaaaaaaaaaaaaag

SEQ ID NO: 229 - protein, 807 aa, Homo sapiens
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 230 - DNA, 50 bp, Artificial Sequence
  Synthetic oligonucleotide probe
cgccttaccgcgcagcccgaagattcactatggtgaaaatcgccttcaat

SEQ ID NO: 231 - DNA, 24 bp, Artificial Sequence
  Synthetic oligonucleotide probe
cctgagctgtaaccccactccagg

SEQ ID NO: 232 - DNA, 23 bp, Artificial Sequence
  Synthetic oligonucleotide probe
agagtctgtcccagctatcttgt

SEQ ID NO: 233 - DNA, 2786 bp, Homo sapiens
ccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcggtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgttttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttgttttgtttttgtttttttgcttttaccaaacatgtctgtaaatcttaacctcctgcctaggatttgtacagcatctggtgtgtgcttataagccaataaatattcaatgtgaaaaaaaaaaaaaaaaa

SEQ ID NO: 234 - protein, 421 aa, Homo sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 235 - DNA, 1743 bp, Homo sapiens
caaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaatcacattttctttaaagccaagtgggagaagccctttcaccttgaatatacaagaaagaacttcccattcctggtgggcgagcaggtcactgtgcaagtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgataaagtggagccactcactccagaaaaggtggatagaggtgttcatccccagattttccatttctgcctcctacaatctggaaaccatcctcccgaagatgggcatccaaaatgcctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggtccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcaaaaaaaaaaaaaaaaaaaaaaaaaaaaaaaaaaaaaaaaaaaaaaaaaaaaaaaaaaaaaaaaaaa

SEQ ID NO: 236 - protein, 417 aa, Homo sapiens
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHLEYTRKNFPFLVGEQVTVQVPMMHQKEQFAFGVDTELNCFVLQMDYKGDAVAFFVLPSKGKMRQLEQALSARTLIKWSHSLQKRWIEVFIPRFSISASYNLETILPKMGIQNAFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 237 - DNA, 23 bp, Artificial Sequence
  Synthetic oligonucleotide probe
caaccatgcaaggacagggcagg

SEQ ID NO: 238 - DNA, 47 bp, Artificial Sequence
  Synthetic oligonucleotide probe
ctttgctgttggcctctgtgctcccaaccatgcaaggacagggcagg

SEQ ID NO: 239 - DNA, 24 bp, Artificial Sequence
  Synthetic oligonucleotide probe
tgactcggggtctccaaaaccagc

SEQ ID NO: 240 - DNA, 24 bp, Artificial Sequence
  Synthetic oligonucleotide probe
ggtataggcggaaggcaaagtcgg

SEQ ID NO: 241 - DNA, 48 bp, Artificial Sequence
  Synthetic oligonucleotide probe
ggcatcttacctttatggagtactctttgctgttggcctctgtgctcc

SEQ ID NO: 242 - DNA, 2436 bp, Homo sapiens
ggctgaccgtgctacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagtcaccaactctgggtccagtgtgacctccagtggagccagcactgccaccaactctgagtccagcacagtgtccagtagggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacagtgtccagtggggccagcactgccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcaaaaaaaaaaaaaaaaaaaaaaaaaaaaaaaaaaaaaaaaaaaaaaaaaaaaaa

SEQ ID NO: 243 - protein, 596 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTVTNSGSSVTSSGASTATNSESSTVSSRASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTVSSGASTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 244 - DNA, 26 bp, Artificial Sequence
  Synthetic oligonucleotide probe
gaagcaccagcctttatctcttcacc

SEQ ID NO: 245 - DNA, 24 bp, Artificial Sequence
  Synthetic oligonucleotide probe
gtcagagttggtggctgtgctagc

SEQ ID NO: 246 - DNA, 48 bp, Artificial Sequence
  Synthetic oligonucleotide probe
ggacccaggcatcttgctttccagccacaaagagacagatgaagatgc

SEQ ID NO: 247 - DNA, 957 bp, Homo sapiens
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcagtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacca

SEQ ID NO: 248 - protein, 247 aa, Homo sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 249 - DNA, 23 bp, Artificial Sequence
  Synthetic oligonucleotide probe
caatatgcatcttgcacgtctgg

SEQ ID NO: 250 - DNA, 24 bp, Artificial Sequence
  Synthetic oligonucleotide probe
aagcttctctgcttcctttcctgc

SEQ ID NO: 251 - DNA, 43 bp, Artificial Sequence
  Synthetic oligonucleotide probe
tgaccccattgagaaggtcattgaagggatcaaccgagggctg

SEQ ID NO: 252 - DNA, 3781 bp, Homo sapiens
ctccgggtccccaggggctgcgccgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtaccggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggagccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaaaaaaaaaaaa

SEQ ID NO: 253 - protein, 837 aa, Homo sapiens [sequence omitted]

SEQ ID NO: 254 - DNA, 24 bp, Artificial Sequence
  Synthetic oligonucleotide probe
agcccgtgcagaatctgctcctgg

SEQ ID NO: 255 - DNA, 24 bp, Artificial Sequence
  Synthetic oligonucleotide probe
tgaagccagggcagcgtcctctgg

SEQ ID NO: 256 - DNA, 18 bp, Artificial Sequence
  Synthetic oligonucleotide probe
gtacaggctgcagttggc

SEQ ID NO: 257 - DNA, 41 bp, Artificial Sequence
  Synthetic oligonucleotide probe
agaagccatgtgagcaagtccagttccagcccaacacagtg

SEQ ID NO: 258 - DNA, 45 bp, Artificial Sequence
  Synthetic oligonucleotide probe
gagctgcagatcttctcatcgggacagcccgtgcagaatctgctc

SEQ ID NO: 259 - DNA, 4563 bp, Homo sapiens
  unsure 3635: unknown base
ctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggtgtgcggaacaaagcgccggcgcggggcctgcgggcggctcgggggccgcgatgggcgcggcgggcccgcggcggcggcggcgctgcccgggccgggcctcgcggcgctagggcgggctggcctccgtgggcgggggcagcgggctgagggcgcgcggagcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcggcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacccagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgttttttttttttacaattgttttaaagccatttcatgttccagttgtaagataaggaaatgtgataatagctgtttcatcattgtcttcaggagagctttccagagttgatcatttcctctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagntagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacatacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgaaaaaa

SEQ ID NO: 260 - protein, 802 aa, Homo sapiens [sequence omitted]

SEQ ID NO: 261 - DNA, 24 bp, Artificial Sequence
  Synthetic oligonucleotide probe
gtgccactacggggtgtggacgac

SEQ ID NO: 262 - DNA, 24 bp, Artificial Sequence
  Synthetic oligonucleotide probe
tcccatttcttccgtggtgcccag

SEQ ID NO: 263 - DNA, 46 bp, Artificial Sequence
  Synthetic oligonucleotide probe
ccagaagaagtccttcatgatgctcaagtacatgcacgaccactac

SEQ ID NO: 264 - DNA, 1419 bp, Homo sapiens
ggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgagcataactgtgacacctgatgaagagcaaaacttgaatcattatatacaagttttagagaacctagtacgaagtgttccctctggggagccaggtcgtgagaaaaaatctaactctccaaaacatgtttattctatagcatcaaagggatcaaaatttaaggagctagttacacatggagacgcttcaactgagaatgatgttttaaccaatcctatcagtgaagaaactacaactttccctacaggaggcttcacaccggaaataggaaagaaaaaacacacggaaagtaccccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgagatctctacagaatcagaagatgttcctcagctctcaggtgaaactgcgatagaaaaacccgaagagtttggaaagcacccagagagttggaataatgatgacattttgaaaaaaattttagatattaattcacaagtgcaacaggcacttcttagtgacaccagcaacccagcatatagagaagatattgaagcctctaaagatcacctaaaacgaagccttgctctagcagcagcagcagaacataaattaaaaacaatgtataagtcccagttattgccagtaggacgaacaagtaataaaattgatgacatcgaaactgttattaacatgctgtgtaattctagatctaaactctatgaatatttagatattaaatgtgttccaccagagatgagagaaaaagctgctacagtattcaatacattaaaaaatatgtgtagatcaaggagagtcacagccttattaaaagtttattaaacaataatataaaaattttaaacctacttgatattccataacaaagctgatttaagcaaactgcattttttcacaggagaaataatcatattcgtaatttcaaaagttgtataaaaatattttctattgtagttcaaatgtgccaacatctttatgtgtcatgtgttatgaacaattttcatatgcactaaaaacctaatttaaaataaaattttggttcaggaaaaaa

SEQ ID NO: 265 - protein, 350 aa, Homo sapiens [sequence omitted]

SEQ ID NO: 266 - DNA, 2403 bp, Homo sapiens
cggctcgagcggctcgagtgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggagagacgtttttccagccctcaccttggcgcctggcttctattttactcgggttactctgtggtgccctgtgtggtgttgtcatggggatgataattgttttcttcaaatccaaagggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggagacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccataaaaaaaaaaaaaaa

SEQ ID NO: 267 - protein, 466 aa, Homo sapiens [sequence omitted]

SEQ ID NO: 268 - DNA, 2103 bp, Homo sapiens
ccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagacaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacgtaagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaagtccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcaccca

SEQ ID NO: 269 - protein, 423 aa, Homo sapiens
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 270 - DNA, 1170 bp, Homo sapiens
gtcgaaggttataaaagcttccagccaaacggcattgaagttgaagatacaacctgacagcacagcctgagatcttggggatccctcagcctaacacccacagacgtcagctggtggattcccgctgcatcaaggcctacccactgtctccatgctgggctctccctgccttctgtggctcctggccgtgaccttcttggttcccagagctcagcccttggcccctcaagactttgaagaagaggaggcagatgagactgagacggcgtggccgcctttgccggctgtcccctgcgactacgaccactgccgacacctgcaggtgccctgcaaggagctacagagggtcgggccggcggcctgcctgtgcccaggactctccagccccgcccagccgcccgacccgccgcgcatgggagaagtgcgcattgcggccgaagagggccgcgcagtggtccactggtgtgcccccttctccccggtcctccactactggctgctgctttgggacggcagcgaggctgcgcagaaggggcccccgctgaacgctacggtccgcagagccgaactgaaggggctgaagccagggggcatttatgtcgtttgcgtagtggccgctaacgaggccggggcaagccgcgtgccccaggctggaggagagggcctcgagggggccgacatccctgccttcgggccttgcagccgccttgcggtgccgcccaacccccgcactctggtccacgcggccgtcggggtgggcacggccctggccctgctaagctgtgccgccctggtgtggcacttctgcctgcgcgatcgctggggctgcccgcgccgagccgccgcccgagccgcaggggcgctctgaaaggggcctgggggcatctcgggcacagacagccccacctggggcgctcagcctggcccccgggaaagaggaaaacccgctgcctccagggagggctggacggcgagctgggagccagccccaggctccagggccacggcggagtcatggttctcaggactgagcgcttgtttaggtccggtacttggcgctttgtttcctggctgaggtctgggaaggaatagaaaggggcccccaatttttttttaagcggccagataataaataatgtaacctttgcggttaaaaaaaaaaaaaaaaaa

SEQ ID NO: 271 - protein, 238 aa, Homo sapiens
MLGSPCLLWLLAVTFLVPRAQPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRTLVHAAVGVGTALALLSCAALVWHFCLRDRWGCPRRAAARAAGAL

SEQ ID NO: 272 - DNA, 2397 bp, Homo sapiens
agagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagcctgggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttattggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagtaa

SEQ ID NO: 273 - protein, 305 aa, Homo sapiens
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLTHAWNFFQREFKCCGVVYFTDWLEMTEMDWPPDSCCVREFPGCSKQAHQEDLSDLYQEGCGKKMYSFLRGTKQLQVLRFLGISIGVTQILAMILTITLLWALYYDRREPGTDQMMSLKNDNSQHLSCPSVELLKPSLSRIFEHTSMANSFNTHFEMEEL

SEQ ID NO: 274 - DNA, 2063 bp, Homo sapiens
gagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcaaaaaaaaaaaa

SEQ ID NO: 275 - protein, 432 aa, Homo sapiens
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSRAVEIGPDQDLDVVEITENSQELRMRNSSGPCLSGSLVSLHCLACGKSLKTPRVVGGEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 276 - DNA, 3143 bp, Homo sapiens
gggctgaggcactgagagaccggaaagcctggcattccagagggagggaaacgcagcggcatccccaggctccagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttaaaaaaa

SEQ ID NO: 277 - protein, 761 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 278 - DNA, 24 bp, Artificial Sequence
  Synthetic oligonucleotide probe
ctgctggtgaaatctggcgtggag

SEQ ID NO: 279 - DNA, 24 bp, Artificial Sequence
  Synthetic oligonucleotide probe
gtctggtcctggctgtccacccag

SEQ ID NO: 280 - DNA, 45 bp, Artificial Sequence
  Synthetic oligonucleotide probe
catcttgtcatgtacctgggaaccaccacagggtcgctccacaag

SEQ ID NO: 281 - DNA, 2320 bp, Homo sapiens
agggtcccttagccgggcgcagggcgcgcagcccaggctgagatccgcggcttccgtagaagtgagcatggctgggcagcgagtgcttcttctagtgggcttccttctccctggggtcctgctctcagaggctgccaaaatcctgacaatatctacagtaggtggaagccattatctactgatggaccgggtttctcagattcttcaagatcacggtcataatgtcaccatgcttaaccacaaaagaggtccttttatgccagattttaaaaaggaagaaaaatcatatcaagttatcagttggcttgcacctgaagatcatcaaagagaatttaaaaagagttttgatttctttctggaagaaactttaggtggcagaggaaaatttgaaaacttattaaatgttctagaatacttggcgttgcagtgcagtcattttttaaatagaaaggatatcatggattccttaaagaatgagaacttcgacatggtgatagttgaaacttttgactactgtcctttcctgattgctgagaagcttgggaagccatttgtggccattctttccacttcattcggctctttggaatttgggctaccaatccccttgtcttatgttccagtattccgttccttgctgactgatcacatggacttctggggccgagtgaagaattttctgatgttctttagtttctgcaggaggcaacagcacatgcagtctacatttgacaacaccatcaaggaacatttcacagaaggctctaggccagttttgtctcatcttctactgaaagcagagttgtggttcattaactctgactttgcctttgattttgctcgacctctgcttcccaacactgtttatgttggaggcttgatggaaaaacctattaaaccagtaccacaagacttggagaacttcattgccaagtttggggactctggttttgtccttgtgaccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgttcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaaatctttccagtcctcttgtcctcctttgtttgccatcagcaagggctatgctgtgattctgtctctgagtgacttggaccactgaccctcagatttccagccttaaaatccaccttccttctcatgcgcctctccgaatcacaccctgactcttccagcctccatgtccagacctagtcagcctctctcactcctgcccctactatctatcatggaataacatccaagaaagacaccttgcatattctttcagtttctgttttgttctcccacatattctcttcaatgctcaggaagcctgccctgtgcttgagagttcagggccggacacaggctcacaggtctccacattgggtccctgtctctggtgcccacagtgagctccttcttggctgagcaggcatggagactgtaggtttccagatttcctgaaaaataaaagtttacagcgttatctctccccaacctcactaa

SEQ ID NO: 282 - protein, 523 aa, Homo sapiens [sequence omitted]

SEQ ID NO: 283 - DNA, 24 bp, Artificial Sequence
  Synthetic oligonucleotide probe
tgcctttgctcacctaccccaagg

SEQ ID NO: 284 - DNA, 24 bp, Artificial Sequence
  Synthetic oligonucleotide probe
tcaggctggtctccaaagagaggg

SEQ ID NO: 285 - DNA, 45 bp, Artificial Sequence
  Synthetic oligonucleotide probe
cccaaagatgtccacctggctgcaaatgtgaaaattgtggactgg

SEQ ID NO: 286 - DNA, 2340 bp, Homo sapiens
gggctgttgatttgtgggggattttgaagagaggaggaataggaggaaggggttgaggggctgcctctggcatatgcacacactcacacattctgtcacacccgtcacacacacataccatgttctccatccccccaggtccagccctcagtgctgtcccatccagcagggctaccctgaagctctggctgcagccctcccgtccagtgggcaggcggcttcatccctcctttctctcccaaagcccaactgctgtcactgcatgctctgccaaggaggagggaactgcagtgacagcaggagtaagagtgggaggcaggacagagctgggacacaggtatggagagggggttcagcgagcctagagagggcagactatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgctgcggtccgaagccaccaccatgagccagcaggggaaaccggcaatggcaccagtggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacccacccacccccagttaccctcccagccacctgctgcatctgttcctgcctgcagccctaggatcagggcaaggtttggcaagaaggaagatctgcactactttgcggcctctgctcctccggttcccccaccccagcttcctgctcaatgctgatcagggacaggtggcgcaggtgagcctgacaggcccccacaggagcccagatggacaagcctcagcgtaccctgcaggcttcttcctgtgaggaaagccagcatcacggatctcagccagcaccgtcagaagctgagccagcaccgtatgggctagggtgggaggctcagccacaggcagaagggtgggaagggcctggagtctgtggctggtgaggaaggaaggagggtgtattgtctagactgaacatggtacacattctgcatgtatagcagagcagccagcaggtagcaatcctggctgtccttctatgctggatcccagatggactctggcccttacctccccacctgagattagggtgagtgtgtttgctctggctgagagcagagctgagagcaggtatacagagctggaagtggaccatggaaaacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcagtgagacactatagaattactaaggagaagatgcctctggagtttggatcgggtgttacaggtacaagtaggtatgttgcagaggaaaataaatatcaaactgtatactaaaattaaaaa

SEQ ID NO: 287 - protein, 205 aa, Homo sapiens
MLGAKPHWLPGPLHSPGLPLVLVLLALGAGWAQEGSEPVLLEGECLVVCEPGRAAAGGPGGAALGEAPPGRVAFAAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 288 - DNA, 24 bp, Artificial Sequence
  Synthetic oligonucleotide probe
aggcagccaccagctctgtgctac

SEQ ID NO: 289 - DNA, 27 bp, Artificial Sequence
  Synthetic oligonucleotide probe
cagagagggaagatgaggaagccagag

SEQ ID NO: 290 - DNA, 42 bp, Artificial Sequence
  Synthetic oligonucleotide probe
ctgtgctactgcccttggaccctggggaccgagtgtctctgc

SEQ ID NO: 291 - DNA, 1570 bp, Homo sapiens
gctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 292 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 293 - DNA, 24 bp, Artificial Sequence
  Synthetic oligonucleotide probe
gctgacctggttcccatctactcc

SEQ ID NO: 294 - DNA, 24 bp, Artificial Sequence
  Synthetic oligonucleotide probe
cccacagacacccatgacacttcc

SEQ ID NO: 295 - DNA, 50 bp, Artificial Sequence
  Synthetic oligonucleotide probe
aagaatgaattgtacaaagcaggtgatcttcgaggagggctcctggggcc

SEQ ID NO: 296 - DNA, 3060 bp, Homo sapiens
gggcggcgggatgggggccgggggcggcgggcgccgcactcgctgaggccccgacgcagggccgggccgggcccagggccgaggagcgcggcggccagagcggggccgcggaggcgacgccggggacgcccgcgcgacgagcaggtggcggcggctgcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagaatcgcttgaacctgggaggtggagattgcagtgagctgagatggcatcactgtactccagcctaggcaacagagcaagactcagtctcaaaaaaaaaaaaaaacaaaaaaaccccagaaattctggagttgaactgtgtagttactgacatgaaaaattcactagaggctgaacagcagatttgagcaggcagaaaaaaatcagcaagcttgaagatggtaccttgagatttttcaggctaatgaaaaaagaatgaaggaaaattaacagcctcagagacccatggtgcaccgtcacacaaatcaacatatgcatgatgagagtcccagaaggagaggagagaaagggtcagaaagaatggccacaagctgatgaaaaacagtaacctacccactcaggaagctcagtgaactccaatgaggatgaatatcagagatccacacctagatatttcataatcaaagtgtcaaatgacaaagaatcttgaaagcagcaagagatgagcaacttatcttgttcaaaggatctttgatcagattaacagctcatttctcctcagaaatcatgggagccaggagatagtgggatgaacactgttgaaggcaaaaccttcaactgtaattattggacttttgagtcttagatggtcctgacctctttgtcttcagggacagtttttcaatttaatccctaataacaattagtcaagcttccttgacctgtaggaaggcctgtctttaggccgggcacagtggcttacacctgtaatcccagcactttgggaggcccagacgggtggatcatttggggtcaggctgatctcaaactcctgagttcaggtgatctgcccgcctcagcctcccaaagtgttgtgattgcaggcgtgagccactgcgcctggccggaatttctttttaaggctgaatgatgggggccaggcacgatggctcacgcctgtgatcccaagtagcttggattgtaaacatgcaccaccatgcctggctaatttttgtatttttagtagagacgtgttagccaggctggtctcgatctcctgacctcaagtgaccacctgcctcagcctcccaaagtactgggattacaggcgtgagccactgtgcctggccttgagcatcttgtgatgtgcttattggccatttgtatatcttctatcttctttggggaaatgtctgttcaagtcctttgcctttttaaatttttattatttatttatttatttattttgagacagggtcttgttctgttgcccaggctggagtacagtggcacagtcttggctcactgcagcctcgacctcctgggctgcagtgatcctcccacctcagcctcccttgtagctgtatttttttgtattttgtattttgtagctgtagtttttgtattttttgtggagacagcatttcaccatgatgcccaggctggtcttgaactcctgagctcaagtgatctgcctgcttcagcctcccaaagtgctgggattacagacatgagccactgcacctggcaaactcccaaaattcaacacacacacacaaaaaaccacctgattcaaaatgggcagaggggccgggtgtggccccaactaccagggagactgaagtgggaggatcgcttgggcatgagaagtcgaggctgcagtgagtcgaggttgtgcgactgcattccagcctggacaacagagtgagaccctgtctc

SEQ ID NO: 297 - protein, 368 aa, Homo sapiens
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGESLEPGRWRLQ

SEQ ID NO: 298 - DNA, 24 bp, Artificial Sequence
  Synthetic oligonucleotide probe
cttcctctgtgggtggaccatgtg

SEQ ID NO: 299 - DNA, 21 bp, Artificial Sequence
  Synthetic oligonucleotide probe
gccacctccatgctaacgcgg

SEQ ID NO: 300 - DNA, 45 bp, Artificial Sequence
  Synthetic oligonucleotide probe
ccaaggtcctcgctaagaaggagctgctctacgtgcccctcatcg

SEQ ID NO: 301 - DNA, 1334 bp, Homo sapiens
gatattctttatttttaagaatctgaagtactatgcatcactccctccaatgtcctggggcagccaccaggcatattcatctttgtgtgtgtttttcttttgctttagcactggggcacttcttgcttatttctttggtaggaaaggggctcagtttgtcttgtggggttggtggcaggcaggccggcttacgcctgatacggccctgggttagaagggaagggaagataaacttttatacaaatggggatagctggggtctgagacctgcttcctcagtaaaattcctgggatctgcctataccttcttttctctaacctggcataccctgcttaaagcctctcagggcttctctctgttcttaggatcaaagtatttagagctacaagagccctcatggtctggcccctgcccccctggccagcttcattgtacatgtggtgttctcttgtcgttcctgtaatgtggtatgccatggggtctttgcacaagcctttcctctttggctggacactgttccctgccccccccatactcttcctacttaatatgtagtcatcctgcagatttcaattctaacatcattttctccagggatcctggcctgacagaatctcatcttgtttaatgctctcataagaccacttgtttcccttttgcagcacttgccactcagttgtatctttatgtgcgtttgtggttgtatgggttgtgtctgttccccagaatgcccagctctgagctgcgtgagggtcaagggcattgctgtgcctgccaggtatagtgcctacatgtggtgggtgctcatgttttagagactaaatggaggaggagatgaggaaaagattgaaatctctcagttcaccagatggtgtagggcccagcattgtaaattcacacgttgactgtgcttgtgaattatctggggatgcaggtcctgattcagtaggcccaggttgggcatctctaacaaactcccacgtgatgctgatgctggtcctatgaactatactaaatagtaagaatctatggagccaggctgggcatggtggctcacacctatgatcccagcactttgggaggctgaggcaggctgatcacctggagtcaggatttcaagactagcctggccaacatggtggaaccccatctgtactaaaaatacacaaattagctgggcatggtggcacatgcctgtagtcccagctacttgggaggctgaagcaagagaatcgcttgaacctgggaggcggaggttgcagtgagccgagatcaggccactgtattccaaccagggtgacagagtgagactctatgtccaaaaaaaaaaaaa

SEQ ID NO: 302 - protein, 143 aa, Homo sapiens
MHHSLQCPGAATRHIHLCVCFSFALALGHFLLISLVGKGLSLSCGVGGRQAGLRLIRPWVRREGKINFYTNGDSWGLRPASSVKFLGSAYTFFSLTWHTLLKASQGFSLFLGSKYLELQEPSWSGPCPPGQLHCTCGVLLSFL

SEQ ID NO: 303 - DNA, 1768 bp, Homo sapiens
ggctggactggaactcctggtcccaagtgatccacccgcctcagcctcccaaggtgctgtgattataggtgtaagccaccgtgtctggcctctgaacaactttttcagcaactaaaaaagccacaggagttgaactgctaggattctgactatgctgtggtggctagtgctcctactcctacctacattaaaatctgttttttgttctcttgtaactagcctttaccttcctaacacagaggatctgtcactgtggctctggcccaaacctgaccttcactctggaacgagaacagaggtttctacccacaccgtcccctcgaagccggggacagcctcaccttgctggcctctcgctggagcagtgccctcaccaactgtctcacgtctggaggcactgactcgggcagtgcaggtagctgagcctcttggtagctgcggctttcaaggtgggccttgccctggccgtagaagggattgacaagcccgaagatttcataggcgatggctcccactgcccaggcatcagccttgctgtagtcaatcactgccctggggccaggacgggccgtggacacctgctcagaagcagtgggtgagacatcacgctgcccgcccatctaaccttttcatgtcctgcacatcacctgatccatgggctaatctgaactctgtcccaaggaacccagagcttgagtgagctgtggctcagacccagaaggggtctgcttagaccacctggtttatgtgacaggacttgcattctcctggaacatgagggaacgccggaggaaagcaaagtggcagggaaggaacttgtgccaaattatgggtcagaaaagatggaggtgttgggttatcacaaggcatcgagtctcctgcattcagtggacatgtgggggaagggctgccgatggcgcatgacacactcgggactcacctctggggccatcagacagccgtttccgccccgatccacgtaccagctgctgaagggcaactgcaggccgatgctctcatcagccaggcagcagccaaaatctgcgatcaccagccaggggcagccgtctgggaaggagcaagcaaagtgaccatttctcctcccctccttccctctgagaggccctcctatgtccctactaaagccaccagcaagacatagctgacaggggctaatggctcagtgttggcccaggaggtcagcaaggcctgagagctgatcagaagggcctgctgtgcgaacacggaaatgcctccagtaagcacaggctgcaaaatccccaggcaaaggactgtgtggctcaatttaaatcatgttctagtaattggagctgtccccaagaccaaaggagctagagcttggttcaaatgatctccaagggcccttataccccaggagactttgatttgaatttgaaaccccaaatccaaacctaagaaccaggtgcattaagaatcagttattgccgggtgtggtggcctgtaatgccaacattttgggaggccgaggcgggtagatcacctgaggtcaggagttcaagaccagcctggccaacatggtgaaacccctgtctctactaaaaatacaaaaaaactagccaggcatggtggtgtgtgcctgtatcccagctactcgggaggctgagacaggagaattacttgaacctgggaggtgaaggaggctgagacaggagaatcacttcagcctgagcaacacagcgagactctgtctcagaaaaaataaaaaaagaattatggttatttgtaa

SEQ ID NO: 304 - protein, 109 aa, Homo sapiens
MLWWLVLLLLPTLKSVFCSLVTSLYLPNTEDLSLWLWPKPDLHSGTRTEVSTHTVPSKPGTASPCWPLAGAVPSPTVSRLEALTRAVQVAEPLGSCGFQGGPCPGRRRD

SEQ ID NO: 305 - DNA, 989 bp, Homo sapiens
gcgggcccgcgagtccgagacctgtcccaggagctccagctcacgtgacctgtcactgcctcccgccgcctcctgcccgcgccatgacccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacacaaaaaaaaaaaaaaaaaaa

SEQ ID NO: 306 - protein, 262 aa, Homo sapiens
MTQPVPRLSVPAALALGSAALGAAFATGLFLGRRCPPWRGRREQCLLPPEDSRLWQYLLSRSMREHPALRSLRLLTLEQPQGDSMMTCEQAQLLANLARLIQAKKALDLGTFTGYSALALALALPADGRVVTCEVDAQPPELGRPLWRQAEAEHKIDLRLKPALETLDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 307 - DNA, 2272 bp, Homo sapiens
ccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaacggttttttaatga

SEQ ID NO: 308 - protein, 671 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 309 - DNA, 3871 bp, Homo sapiens
gttggttctcctggatcttcaccttaccaactgcagatcttgggactcatcagcctcaataattatattaaattaacaccatttgaaagagaacattgttttcatcatgaatgctaataaagatgaaagacttaaagccagaagccaagattttcacctttttcctgctttgatgatgctaagcatgaccatgttgtttcttccagtcactggcactttgaagcaaaatattccaagactcaagctaacctacaaagacttgctgctttcaaatagctgtattccctttttgggttcatcagaaggactggattttcaaactcttctcttagatgaggaaagaggcaggctgctcttgggagccaaagaccacatctttctactcagtctggttgacttaaacaaaaattttaagaagatttattggcctgctgcaaaggaacgggtggaattatgtaaattagctgggaaagatgccaatacagaatgtgcaaatttcatcagagtacttcagccctataacaaaactcacatatatgtgtgtggaactggagcatttcatccaatatgtgggtatattgatcttggagtctacaaggaggatattatattcaaactagacacacataatttggagtctggcagactgaaatgtcctttcgatcctcagcagccttttgcttcagtaatgacagatgagtacctctactctggaacagcttctgatttccttggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacagacattggaactgtcctcaaagttgtcagcatttcaaaggaaaagtggaatatggaagaggtagtgctggaggagttgcagatattcaagcactcatcaatcatcttgaacatggaattgtctctgaagcagcaacaattgtacattggttcccgagatggattagttcagctctccttgcacagatgcgacacttatgggaaagcttgcgcagactgttgtcttgccagagacccctactgtgcctgggatggaaatgcatgctctcgatatgctcctacttctaaaaggagagctagacgccaagatgtaaaatatggcgacccaatcacccagtgctgggacatcgaagacagcattagtcatgaaactgctgatgaaaaggtgatttttggcattgaatttaactcaacctttctggaatgtatacctaaatcccaacaagcaactattaaatggtatatccagaggtcaggggatgagcatcgagaggagttgaagcccgatgaaagaatcatcaaaacggaatatgggctactgattcgaagtttgcagaagaaggattctgggatgtattactgcaaagcccaggagcacactttcatccacaccatagtgaagctgactttgaatgtcattgagaatgaacagatggaaaatacccagagggcagagcatgaggaggggcaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctacttaatttaaagaaaagaattccttacctataaaaacattgccttctgttttgtatatcccttatagtaattcataaatgcttcccatggagttttgctaaggcacaagacaataatctgaataagacaatatgtgatgaatataagaaagggcaaaaaattcatttgaaccagttttccaagaacaaatcttgcacaagcaaagtataagaattatcctaaaaatagggggtttacagttgtaaatgttttatgttttgagttttggaatttattgtcatgtaaatagttgagctaagcaagccccgaatttgatagtgtataaggtgctttattccctcgaatgtccattaagcatggaatttaccatgcagttgtgctatgttcttatgaacagatatatcattcctattgagaaccagctaccttgtggtagggaataagaggtcagacacaaattaagacaactcccattatcaacaggaactttctcagtgagccattcactcctggagaatggtataggaatttggagaggtgcattatttctttctggccactggggttaaatttagtgtactacaacattgatttactgaagggcactaatgtttcccccaggatttctattgactagtcaggagtaacaggttcacagagagaagttggtgcttagttatgtgttttttagagtatatactaagctctacagggacagaatgcttaataaatactttaataagatatgggaaaatattttaataaaacaaggaaaacataatgatgtataatgcatcctgatgggaaggcatgcagatgggatttgttagaagacagaaggaaagacagccataaattctggctttggggaaaactcatatccccatgaaaaggaagaacaatcacaaataaagtgagagtaatgtaatggagctcttttcactagggtataagtagctgccaatttgtaattcatctgttaaaaaaaatctagattataacaaactgctagcaaaatctgaggaaacataaattcttctgaagaatcataggaagagtagacattttatttataaccaatgatatttcagtatatattttctctcttttaaaaaatatttatcatactctgtatattatttctttttactgcctttattctctcctgtatattggattttgtgattatatttgagtgaataggagaaaacaatatataacacacagagaattaagaaaatgacatttctggggagtggggatatatatttgttgaataacagaacgagtgtaaaattttaacaacggaaagggttaaattaactctttgacatcttcactcaaccttttctcattgctgagttaatctgttgtaattgtagtattgtttttgtaatttaacaataaataagcctgctacatgt

SEQ ID NO: 310 - protein, 777 aa, Homo sapiens [sequence omitted]

SEQ ID NO: 311 - DNA, 25 bp, Artificial Sequence
  Synthetic oligonucleotide probe
caacgcagccgtgataaacaagtgg

SEQ ID NO: 312 - DNA, 24 bp, Artificial Sequence
  Synthetic oligonucleotide probe
gcttggacatgtaccaggccgtgg

SEQ ID NO: 313 - DNA, 45 bp, Artificial Sequence
  Synthetic oligonucleotide probe
ggccagactgatttgctcaattcctggaagtgatggggcagatac

SEQ ID NO: 314 - DNA, 3934 bp, Homo sapiens
ccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagccattgagggtgtcatggagctacagaggggagggaaaggtattttaaggtaacagtgtggcacaatagttaagagcacagtttttggagctagaccgacataggttcaaattctcttctgttgcttcctagttctgtagccccaggtaagggagtgacttaacctctctggacttcaatttcctcatcactaaagtagggccaataatagcacccacctcatagggaagattaaatgacataatgtatgtgatgcaactagcaaagtaccagtcccatagtaagtcatgccccacagtatttccacccacccctgttctctgccttcccaaccaggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactctgggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtcccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgctggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggatgcaaggggctgcagagcccaggtgcactgtgtgatgatgggagggggctccgtcctgcaggctggaggtggcatccacactggacagcaggaggaggggagtgagggtaacatttccatttcccttcatgttttgtttcttacgttctttcagcatgctccttaaaaccccagaagccccaatttccccaagccccattttttcttgtctttatctaataaactcaatattaag

SEQ ID NO: 315 - protein, 370 aa, Homo sapiens
MQLAKYQSHSKSCPTVFPPTPVLCLPNQVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGDKALDFPGFLDMMAPRLRPMRPPPPPPAKAPDPGHPDPLT

SEQ ID NO: 316 - DNA, 4407 bp, Homo sapiens
cacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcgggccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccagctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactcaaaaaaaaaaaaaaaaaaaaaaaaaaaaaaaaaaaaaaaaaaaaaaaaaaaaaaaaaaaaaaaaaaaaaaaaaaaaaaaggaaa

SEQ ID NO: 317 - protein, 837 aa, Homo sapiens [sequence omitted]

SEQ ID NO: 318 - DNA, 23 bp, Artificial Sequence
  Synthetic oligonucleotide probe
ccctgaagctgccagatggctcc

SEQ ID NO: 319 - DNA, 24 bp, Artificial Sequence
  Synthetic oligonucleotide probe
ctgtgctcttcggtgcagccagtc

SEQ ID NO: 320 - DNA, 43 bp, Artificial Sequence
  Synthetic oligonucleotide probe
ccacagatgtggtactgcctggggcagtcagcttgcgctacag

SEQ ID NO: 321 - DNA, 1197 bp, Homo sapiens
cagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaaaaaaaaaaaaaaaaaaa

SEQ ID NO: 322 - protein, 317 aa, Homo sapiens
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 323 - DNA, 1174 bp, Homo sapiens
gcggaactggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaaaaaaaaaaaa

SEQ ID NO: 324 - protein, 239 aa, Homo sapiens
MASTAVQLLGFLLSFLGMVGTLITTILPHWRRTAHVGTNILTAVSYLKGLWMECVWHSTGIYQCQIYRSLLALPQDLQAARALMVISCLLSGIACACAVIGMKCTRCAKGTPAKTTFAILGGTLFILAGLLCMVAVSWTTNDVVQNFYNPLLPSGMKFEIGQALYLGFISSSLSLIGGTLLCLSCQDEAPYRPYQAPPRATTTTANTAPAYQPPAAYKDNRAPSVTSATHSGYRLNDYV

SEQ ID NO: 325 - DNA, 2121 bp, Homo sapiens
gagctcccctcaggagcgcgttagcttcacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcacacctgtaatcctagcactttgggaggctgaggaggaaggatcacttgagcccagaagttcgagactagcctgggcaacatggagaagccctgtctctacaaaatacagagagaaaaaatcagccagtcatggtggcatacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaa

SEQ ID NO: 326 - protein, 261 aa, Homo sapiens
MSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 327 - DNA, 2010 bp, Homo sapiens
ggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaacgcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaatt

SEQ ID NO: 328 - protein, 225 aa, Homo sapiens
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 329 - DNA, 1315 bp, Homo sapiens
tcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatcatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgca

SEQ ID NO: 330 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 331 - DNA, 1160 bp, Homo sapiens
gccaaggagaacatcatcaaagacttctctagactcaaaaggcttccacgttctacatcttgagcatcttctaccactccgaattgaaccagtcttcaaagtaaaggcaatggcattttatcccttgcaaattgctgggctggttcttgggttccttggcatggtggggactcttgccacaacccttctgcctcagtggtggagtatcagcttttgttggcagcaacattattgtctttgagaggctctgggaagggctctggatgaattgcatccgacaagccagggtccggttgcaatgcaagttctatagctccttgttggctctcccgcctgccctggaaacagcccgggccctcatgtgtgtggctgttgctctctccttgatcgccctgcttattggcatctgtggcatgaagcaggtccagtgcacaggctctaacgagagggccaaagcataccttctgggaacttcaggagtcctcttcatcctgacgggtatcttcgttctgattccggtgagctggacagccaatataatcatcagagatttctacaacccagccatccacataggtcagaaacgagagctgggagcagcacttttccttggctgggcaagcgctgctgtcctcttcattggagggggtctgctttgtggattttgctgctgcaacagaaagaagcaagggtacagatatccagtgcctggctaccgtgtgccacacacagataagcgaagaaatacgacaatgcttagtaagacctccaccagttatgtctaatgcctccttttggctccaagtatggactatggtcaatgttttttataaagtcctgctagaaactgtaagtatgtgaggcaggagaacttgctttatgtctagatttacattgatacgaaagtttcaatttgttactggtggtaggaatgaaaatgacttacttggacattctgacttcaggtgtattaaatgcattgactattgttggacccaatcgctgctccaattttcatattctaaattcaagtatacccataatcattagcaagtgtacaatgatggactacttattactttttgaccatcatgtattatctgataagaatctaaagttgaaattgatattctataacaataaaacatatacctattcta

SEQ ID NO: 332 - protein, 173 aa, Homo sapiens
MNCIRQARVRLQCKFYSSLLALPPALETARALMCVAVALSLIALLIGICGMKQVQCTGSNERAKAYLLGTSGVLFILTGIFVLIPVSWTANIIIRDFYNPAIHIGQKRELGAALFLGWASAAVLFIGGGLLCGFCCCNRKKQGYRYPVPGYRVPHTDKRRNTTMLSKTSTSYV

SEQ ID NO: 333 - DNA, 535 bp, Homo sapiens
agtgacaatctcagagcagcttctacaccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcttcatcatcccaggctctgactgagtttctttcagttttactgatgttctgggtgggggacagagccagattcagagtaatcttgactgaatggagaaagtttctgtgctacccctacaaacccatgcctcactgacagaccagcattttttttttaacacgtcaataaaaaaataatctcccaga

SEQ ID NO: 334 - protein, 85 aa, Homo sapiens
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 335 - DNA, 742 bp, Homo sapiens
cccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgatgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaaga

SEQ ID NO: 336 - protein, 148 aa, Homo sapiens
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 337 - DNA, 1310 bp, Homo sapiens
cggctcgagcccgcccggaagtgcccgaggggccgcgatggagctgggggagccgggcgctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaacctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttaaaaaaaaaaaaaaaaaa

SEQ ID NO: 338 - protein, 246 aa, Homo sapiens
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 339 - DNA, 849 bp, Homo sapiens
gagattggaaacagccaggttggagcagtgagtgagtaaggaaacctggctgccctctccagattccccaggctctcagagaagatcagcagaaagtctgcaagaccctaagaaccatcagccctcagctgcacctcctcccctccaaggatgacaaaggcgctactcatctatttggtcagcagctttcttgccctaaatcaggccagcctcatcagtcgctgtgacttggcccaggtgctgcagctggaggacttggatgggtttgagggttactccctgagtgactggctgtgcctggcttttgtggaaagcaagttcaacatatcaaagataaatgaaaatgcggatggaagctttgactatggcctcttccagatcaacagccactactggtgcaacgattataagagttactcggaaaacctttgccacgtagactgtcaagatctgctgaatcccaaccttcttgcaggcatccactgcgcaaaaaggattgtgtccggagcacgggggatgaacaactgggtagaatggaggttgcactgttcaggccggccactctcctactggctgacaggatgccgcctgagatgaaacagggtgcgggtgcaccgtggagtcattccaagactcctgtcctcactcagggattcttcatttcttcttcctactgcctccacttcatgttattttcttcccttcccatttacaactaaaactgaccagagccccaggaataaatggttttcttggcttcctccttactcccatctggacccagtcccctggttcctgtctgttatttgtaaactgaggaccacaataaagaaatctttatatttatcg

SEQ ID NO: 340 - protein, 148 aa, Homo sapiens [sequence omitted]

SEQ ID NO: 341 - DNA, 23 bp, Artificial Sequence
  Synthetic oligonucleotide probe
ccctccaaggatgacaaaggcgc

SEQ ID NO: 342 - DNA, 29 bp, Artificial Sequence
  Synthetic oligonucleotide probe
ggtcagcagctttcttgccctaaatcagg

SEQ ID NO: 343 - DNA, 24 bp, Artificial Sequence
  Synthetic oligonucleotide probe
atctcaggcggcatcctgtcagcc

SEQ ID NO: 344 - DNA, 24 bp, Artificial Sequence
  Synthetic oligonucleotide probe
gtggatgcctgcaagaaggttggg

SEQ ID NO: 345 - DNA, 45 bp, Artificial Sequence
  Synthetic oligonucleotide probe
agctttcttgccctaaatcaggccagcctcatcagtcgctgtgac

SEQ ID NO: 346 - DNA, 2575 bp, Homo sapiens
tctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccatgttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgatttgaccagataaatgctgtggatgaacgatgaatgtcaatgtcagaaggaaaagagaattttggccatcaaaatccagctccaagtgaacgtaaagagcttatatatttcatgaagctgatccttttgtgtgtgtgctccttgtgttaggagagaaaaaagctctatgaaagaatataggaagtttctccttttcacaccttatttcattgactgctggctgctta

SEQ ID NO: 347 - protein, 639 aa, Homo sapiens
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 348 - DNA, 23 bp, Artificial Sequence
  Synthetic oligonucleotide probe
ggagaggtggtggccatggacag

SEQ ID NO: 349 - DNA, 24 bp, Artificial Sequence
  Synthetic oligonucleotide probe
ctgtcactgcaaggagccaacacc

SEQ ID NO: 350 - DNA, 45 bp, Artificial Sequence
  Synthetic oligonucleotide probe
tatgtcgctgcgaggtggtgaaaacctcgaactgtctttcaaggc

SEQ ID NO: 351 - DNA, 2524 bp, Homo sapiens
cgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataa

SEQ ID NO: 352 - protein, 243 aa, Homo sapiens [sequence omitted]

SEQ ID NO: 353 - DNA, 480 bp, Homo sapiens
gttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggcaaaaaaaaaaaaaaa

SEQ ID NO: 354 - protein, 121 aa, Homo sapiens
MASCLALRMALLLVSGVLAPAVLTDDVPQEPVPTLWNEPAELPSGEGPVESTSPGREPVDTGPPAPTVAPGPEDSTAQERLDQGGGSLGPGAIAAIVIAALLATCVVLALVVVALRKFSAS

SEQ ID NO: 355 - DNA, 2134 bp, Homo sapiens
ggccgttggttggtgcgcggctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaaggcacctggcaccaggcagctggggaggagggcagctctccagggagggacccagcctagcacctgaaggatcaatgccatcaccccgcggggacctcccctaagtagcccccagaggcgctgggagtgttgccaccgccctcccctgaagtttgctccatctcacgctgggggtcaacctggggaccccttccctccgggccatggacacacatacatgaaaaccaggccgcatcgactgtcagcaccgctgtggcatcttccagtacgagaccatctcctgcaacaactgcacagactcgcacgtcgcctgctttggctataactgcgagtagggctcaggcatcacacccacccgtgccagggccctactgtccctggggtcccaggctctccttggagggggctccccgccttccacctggctgtcatcgggtagggcggggccgtgggttcaggggcgcaccacttccaagcctgtgtcccacaggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcagggggagggggtaaagggagagaggaggggggctagggggtcctctagatcagtgggggcactgcaggtggggctctccctatacctgggacacctgctggatgtcacctctgcaaccacacccatgtggtggtttcatgaacagaccacgctcctctgccttctcctggcctgggacacacagagccaccccggccttgtgagtgacccagagaagggaggcctcgggagaaggggtgctcgtaagccaacaccagcgtgccgcggcctgcacacccttcggacatcccaggcacgagggtgtcgtggatgtggccacacataggaccacacgtcccagctgggaggagaggcctggggcccccagggagggaggcagggggtgggggacatggagagctgaggcagcctcgtctccccgcagcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctc

SEQ ID NO: 356 - protein, 157 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIERHLAPGSWGGGQLSREGPSLAPEGSMPSPRGDLP

SEQ ID NO: 357 - DNA, 1536 bp, Homo sapiens
agcaggagcaggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttata

SEQ ID NO: 358 - protein, 273 aa, Homo sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 359 - DNA, 24 bp, Artificial Sequence
  Synthetic oligonucleotide probe
ccagcagtgcccatactccatagc

SEQ ID NO: 360 - DNA, 20 bp, Artificial Sequence
  Synthetic oligonucleotide probe
tgacgagtgggatacactgc

SEQ ID NO: 361 - DNA, 24 bp, Artificial Sequence
  Synthetic oligonucleotide probe
gctctacggaaacttctgctgtgg

SEQ ID NO: 362 - DNA, 50 bp, Artificial Sequence
  Synthetic oligonucleotide probe
attcccaggcgtgtcatttgggatcagcactgattctgaggttctgacac

SEQ ID NO: 363 - DNA, 1777 bp, Homo sapiens
ggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggtttta

SEQ ID NO: 364 - protein, 269 aa, Homo sapiens
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 365 - DNA, 1321 bp, Homo sapiens
gccggctgtgcagagacgccatgtaccggctcctgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtaaaaaaa

SEQ ID NO: 366 - protein, 373 aa, Homo sapiens [sequence omitted]

SEQ ID NO: 367 - DNA, 30 bp, Artificial Sequence
  Synthetic oligonucleotide probe
tggaaaagaagtctggtcagaaggtttagg

SEQ ID NO: 368 - DNA, 25 bp, Artificial Sequence
  Synthetic oligonucleotide probe
catttggcttcattctcctgctctg

SEQ ID NO: 369 - DNA, 28 bp, Artificial Sequence
  Synthetic oligonucleotide probe
aaaacctcagaacaactcattttgcacc

SEQ ID NO: 370 - DNA, 41 bp, Artificial Sequence
  Synthetic oligonucleotide probe
gtctcaccatggttgctcttgccaaattgtgggaagcaggg

SEQ ID NO: 371 - DNA, 1150 bp, Homo sapiens
gtgacactatagaagagctatgacgtcgcatgcacgcgtacgtaagctcggaattcggctcgaggctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcaaaaaaaaa

SEQ ID NO: 372 - protein, 269 aa, Homo sapiens [sequence omitted]

SEQ ID NO: 373 - DNA, 1706 bp, Homo sapiens
ggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgctgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaaaaa

SEQ ID NO: 374 - protein, 450 aa, Homo sapiens
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 375 - DNA, 1098 bp, Homo sapiens
gcgacgcgcggcggggcggcgagaggaaacgcggcgccgggccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggagatgatccaggacagtacccagcgcacagctgacatccccgccctcttcctgctcggccgagacggctacatgatccgccgctctctggaacagcatgggctgccatgggccatcatttccatcccagtcaatgtcaccagcatccccacctttgagctgctgcaaccgccctggaccttctggtagaagagtttgtcccacattccagccataagtgactctgagctgggaaggggaaacccaggaattttgctacttggaatttggagatagcatctggggacaagtggagccaggtagaggaaaagggtttgggcgttgctaggctgaaagggaagccacaccactggccttcccttccccagggcccccaagggtgtctcatgctacaagaagaggcaagagacaggccccagggcttctggctagaacccgaaacaaaaggagctgaaggcaggtggcctgagagccatctgtgacctgtcacactcacctggctccagcctcccctacccagggtctctgcacagtgaccttcacagcagttgttggagtggtttaaagagctggtgtttggggactcaataaaccctcactgactttttagcaataaagcttctcatcagggttgcaaaaaaaaaaaaaaaaaaaaaaaaaa

SEQ ID NO: 376 - protein, 188 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 377 - DNA, 496 bp, Homo sapiens
  unsure 396: unknown base
tctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcggcatctacaaggacaacaacaaaagcagcatacattgtatggatttatctcaacgctattgtttaatggctgtgtttaatgtgatctatctggaaaatgaggactccgaataaaaagctattactawttnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 378 - protein, 116 aa, Homo sapiens [sequence omitted]

SEQ ID NO: 379 - DNA, 24 bp, Artificial Sequence
  Synthetic oligonucleotide probe
ctgcctccactgctctgtgctggg

SEQ ID NO: 380 - DNA, 24 bp, Artificial Sequence
  Synthetic oligonucleotide probe
cagagcagtggatgttcccctggg

SEQ ID NO: 381 - DNA, 45 bp, Artificial Sequence
  Synthetic oligonucleotide probe
ctgaacaagatggtcaagcaagtgactgggaaaatgcccatcctc

SEQ ID NO: 382 - DNA, 764 bp, Homo sapiens
ctcgcttcttccttctggatgggggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgtgtggtggtggctgatggtactggagtaactgagtcgggacgctgaatctgaatccaccaataaataaagcttctgcagaaaa

SEQ ID NO: 383 - protein, 178 aa, Homo sapiens
MHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 384 - DNA, 2379 bp, Homo sapiens
gctgagcgtgtgcgcggtacggggctctcctgccttctgggctccaacgcagctctgtggctgaactgggtgctcatcacgggaactgctgggctatggaatacagatgtggcagctcaggtagccccaaattgcctggaagaatacatcatgtttttcgataagaagaaattgtaggatccagttttttttttaaccgccccctccccaccccccaaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttggtggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataggtaaaaaaaaaaa

SEQ ID NO: 385 - protein, 513 aa, Homo sapiens
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEV

SEQ ID NO: 386 - DNA, 24 bp, Artificial Sequence
  Synthetic oligonucleotide probe
ctgggatctgaacagtttcggggc

SEQ ID NO: 387 - DNA, 24 bp, Artificial Sequence
  Synthetic oligonucleotide probe
ggtccccaggacatggtctgtccc

SEQ ID NO: 388 - DNA, 48 bp, Artificial Sequence
  Synthetic oligonucleotide probe
gctgagtttacatttacggtctaactccctgagaaccatccctgtgcg

SEQ ID NO: 389 - DNA, 1449 bp, Homo sapiens
agttctgagaaagaaggaaataaacacaggcaccaaaccactatcctaagttgactgtcctttaaatatgtcaagatccagacttttcagtgtcacctcagcgatctcaacgatagggatcttgtgtttgccgctattccagttggtgctctcggacctaccatgcgaagaagatgaaatgtgtgtaaattataatgaccaacaccctaatggctggtatatctggatcctcctgctgctggttttggtggcagctcttctctgtggagctgtggtcctctgcctccagtgctggctgaggagaccccgaattgattctcacaggcgcaccatggcagtttttgctgttggagacttggactctatttatgggacagaagcagctgtgagtccaactgttggaattcaccttcaaactcaaacccctgacctatatcctgttcctgctccatgttttggccctttaggctccccacctccatatgaagaaattgtaaaaacaacctgattttaggtgtggattatcaatttaaagtattaacgacatctgtaattccaaaacatcaaatttaggaatagttatttcagttgttggaaatgtccagagatctattcatatagtctgaggaaggacaattcgacaaaagaatggatgttggaaaaaattttggtcatggagatgtttaaatagtaaagtagcaggcttttgatgtgtcactgctgtatcatacttttatgctacacaaccaaattaatgcttctccactagtatccaaacaggcaacaattaggtgctggaagtagtttccatcacatttaggactccactgcagtatacagcacaccattttctgctttaaactctttcctagcatggggtccataaaaattattataatttaacaatagcccaagccgagaatccaacatgtccagaaccagaaccagaaagatagtatttgaatgaaggtgaggggagagagtaggaaaaagaaaagtttggagttgaagggtaaaggataaatgaagaggaaaaggaaaagattacaagtctcagcaaaaacaagaggttttatgccccaacctgaagaggaagaaattgtagatagaaggtgaaggagattgctgaagatatagagcacatataatgccaacacggggagaaaagaaaatttccccttttacagtaatgaatgtggcctccatagtccatagtgtttctctggagcctcagggcttggcatttattgcagcatcatgctaagaaccttcggcataggtatctgttcccatgaggactgcagaagtagcaatgagacatcttcaagtggcattttggcagtggccatcagcagggggacagacaaaaacatccatcacagatgacatatgatcttcagctgacaaatttgttgaacaaaacaataaacatcaatagatatctaaaaa

SEQ ID NO: 390 - protein, 146 aa, Homo sapiens
MSRSRLFSVTSAISTIGILCLPLFQLVLSDLPCEEDEMCVNYNDQHPNGWYIWILLLLVLVAALLCGAVVLCLQCWLRRPRIDSHRRTMAVFAVGDLDSIYGTEAAVSPTVGIHLQTQTPDLYPVPAPCFGPLGSPPPYEEIVKTT

SEQ ID NO: 391 - DNA, 26 bp, Artificial Sequence
  Synthetic oligonucleotide probe
cttttcagtgtcacctcagcgatctc

SEQ ID NO: 392 - DNA, 23 bp, Artificial Sequence
  Synthetic oligonucleotide probe
ccaaaacatggagcaggaacagg

SEQ ID NO: 393 - DNA, 47 bp, Artificial Sequence
  Synthetic oligonucleotide probe
ccagttggtgctctcggacctaccatgcgaagaagatgaaatgtgtg

SEQ ID NO: 394 - DNA, 2340 bp, Homo sapiens
gagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaacttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaagtgttaacattatattatataagagtatcctttatgaaattttgaatttgtataacagatgcattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggt

SEQ ID NO: 395 - protein, 140 aa, Homo sapiens
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVNGSAANTTNGTSGNLVPVTTNKRTNVSGSIR

SEQ ID NO: 396 - DNA, 2639 bp, Homo sapiens
cgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtgcccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggcagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaggtttaaaaaaaaaaaaaaaaaaaaaaaaaaaaaaaaaaaaaaaaaaaaaaa

SEQ ID NO: 397 - protein, 353 aa, Homo sapiens [sequence omitted]

SEQ ID NO: 398 - DNA, 23 bp, Artificial Sequence
  Synthetic oligonucleotide probe
ccctgccagccgagagcttcacc

SEQ ID NO: 399 - DNA, 23 bp, Artificial Sequence
  Synthetic oligonucleotide probe
ggttggtgcccgaaaggtccagc

SEQ ID NO: 400 - DNA, 44 bp, Artificial Sequence
  Synthetic oligonucleotide probe
caaccccaagcttaactgggcaggagctgaggtgttttcaggcc

SEQ ID NO: 401 - DNA, 1571 bp, Homo sapiens
gatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttactcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctctcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataccaaaaaaaaaaaaaaaaaaa

SEQ ID NO: 402 - protein, 261 aa, Homo sapiens
MRQFPKTSFDISPEMSFSIYSLQVPAVPGLTCWALTAEPGWGQNKGATTCATNSHSDSELRPEIFSSREAWQFFLLLWSPDFRPKMKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLSHAHMTCHCGEEAMKKYSQILSHFEKLEPQAAVVKALGELDILLQWMEETE

SEQ ID NO: 403 - DNA, 28 bp, Artificial Sequence
  Synthetic oligonucleotide probe
ctcctgtggtctccagatttcaggccta

SEQ ID NO: 404 - DNA, 26 bp, Artificial Sequence
  Synthetic oligonucleotide probe
agtcctccttaagattctgatgtcaa

SEQ ID NO: 405 - DNA, 998 bp, Homo sapiens
ccgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaa

SEQ ID NO: 406 - protein, 323 aa, Homo sapiens
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMTPWSMVFWLTYEKIREMSGVSPF

SEQ ID NO: 407 - DNA, 31 bp, Artificial Sequence
  Synthetic oligonucleotide probe
cgcggatcccgttatcgtcttgcgctactgc

SEQ ID NO: 408 - DNA, 34 bp, Artificial Sequence
  Synthetic oligonucleotide probe
gcggaattcttaaaatggactgactccactcatc

SEQ ID NO: 409 - DNA, 1487 bp, Homo sapiens
cggacgcgtgggcgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccagctacctgggaggctgaggcaggagaatcgcttgaacccggggggcagaggttgcagtgagctgagtttgcgccactgcactctagcctgggggagaaagtgaaactccctctcaaaaaaaagaccactctcagtatctctgatttctgaagatgtacaaaaaaatatagcttcatatatctggaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaa

SEQ ID NO: 410 - protein, 158 aa, Homo sapiens
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 411 - DNA, 20 bp, Artificial Sequence
  Synthetic oligonucleotide probe
gtttgaggaagctgggatac

SEQ ID NO: 412 - DNA, 20 bp, Artificial Sequence
  Synthetic oligonucleotide probe
ccaaactcgagcacctgttc

SEQ ID NO: 413 - DNA, 40 bp, Artificial Sequence
  Synthetic oligonucleotide probe
atggcaggcttcctagataattttcgttggccagaatgtg

SEQ ID NO: 414 - DNA, 1337 bp, Homo sapiens
gttgatggcaaacttcctcaaaggaggggcagagcctgcgcagggcaggagcagctggcccactggcggcccgcaacactccgtctcaccctctgggcccactgcatctagaggagggccgtctgtgaggccactacccctccagcaactgggaggtgggactgtcagaagctggcccagggtggtggtcagctgggtcagggacctacggcacctgctggaccacctcgccttctccatcgaagcagggaagtgggagcctcgagccctcgggtggaagctgaccccaagccacccttcacctggacaggatgagagtgtcaggtgtgcttcgcctcctggccctcatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggccctactatgtgctttgaagaccgcatgatcatgagtcctgtgaaaaacaatgtgggcagaggcctaaacatcgccctggtgaatggaaccacgggagctgtgctgggacagaaggcatttgacatgtactctggagatgttatgcacctagtgaaattccttaaagaaattccggggggtgcactggtgctggtggcctcctacgacgatccagggaccaaaatgaacgatgaaagcaggaaactcttctctgacttggggagttcctacgcaaaacaactgggcttccgggacagctgggtcttcataggagccaaagacctcaggggtaaaagcccctttgagcagttcttaaagaacagcccagacacaaacaaatacgagggatggccagagctgctggagatggagggctgcatgcccccgaagccattttagggtggctgtggctcttcctcagccaggggcctgaagaagctcctgcctgacttaggagtcagagcccggcaggggctgaggaggaggagcagggggtgctgcgtggaaggtgctgcaggtccttgcacgctgtgtcgcgcctctcctcctcggaaacagaaccctcccacagcacatcctacccggaagaccagcctcagagggtccttctggaaccagctgtctgtggagagaatggggtgctttcgtcagggactgctgacggctggtcctgaggaaggacaaactgcccagacttgagcccaattaaattttatttttgctggttttgaaaaaaaaaaaaaaaaaaaa

SEQ ID NO: 415 - protein, 224 aa, Homo sapiens
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDDPGTKMNDESRKLFSDLGSSYAKQLGFRDSWVFIGAKDLRGKSPFEQFLKNSPDTNKYEGWPELLEMEGCMPPKPF

SEQ ID NO: 416 - DNA, 21 bp, Artificial Sequence
  Synthetic oligonucleotide probe
gccatagtcacgacatggatg

SEQ ID NO: 417 - DNA, 18 bp, Artificial Sequence
  Synthetic oligonucleotide probe
ggatggccagagctgctg

SEQ ID NO: 418 - DNA, 26 bp, Artificial Sequence
  Synthetic oligonucleotide probe
aaagtacaagtgtggcctcatcaagc

SEQ ID NO: 419 - DNA, 24 bp, Artificial Sequence
  Synthetic oligonucleotide probe
tctgactcctaagtcaggcaggag

SEQ ID NO: 420 - DNA, 24 bp, Artificial Sequence
  Synthetic oligonucleotide probe
attctctccacagacagctggttc

SEQ ID NO: 421 - DNA, 46 bp, Artificial Sequence
  Synthetic oligonucleotide probe
gtacaagtgtggcctcatcaagccctgcccagccaactactttgcg

SEQ ID NO: 422 - DNA, 1701 bp, Homo sapiens
  unsure 1528: unknown base
gagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcttagagaggaatggacccaggctgtcattccaggaagaactgcagagccttcagcctctccaaacatgtaggaggaaatgaggaaatcgctgtgttgttaatgcagagancaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgacttt

SEQ ID NO: 423 - protein, 337 aa, Homo sapiens
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 424 - DNA, 18 bp, Artificial Sequence
  Synthetic oligonucleotide probe
gtaaagtcgctggccagc

SEQ ID NO: 425 - DNA, 18 bp, Artificial Sequence
  Synthetic oligonucleotide probe
cccgatctgcctgctgta

SEQ ID NO: 426 - DNA, 24 bp, Artificial Sequence
  Synthetic oligonucleotide probe
ctgcactgtatggccattattgtg

SEQ ID NO: 427 - DNA, 45 bp, Artificial Sequence
  Synthetic oligonucleotide probe
cagaaacccatgataccctactgaacaccgaatcccctggaagcc

SEQ ID NO: 428 - DNA, 1073 bp, Homo sapiens
aatttttcaccagagtaaacttgagaaaccaactggaccttgagtattgtacattttgcctcgtggacccaaaggtagcaatctgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaactggaaaaaaaaaaaaaaaaaaaaaaaaaaaaaaaaaaaaaaaaaaaaaaaaaaaaaaaaaaaaaaaaaaaaaaaaaaaa

SEQ ID NO: 429 - protein, 209 aa, Homo sapiens
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 430 - DNA, 1257 bp, Homo Sapien
ggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatgttattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaaca

SEQ ID NO: 431 - protein, 243 aa, Homo Sapien [sequence omitted]

SEQ ID NO: 432 - DNA, 18 bp, Artificial Sequence
  Synthetic oligonucleotide probe
aggacttgccctcaggaa

SEQ ID NO: 433 - DNA, 21 bp, Artificial Sequence
  Synthetic oligonucleotide probe
cgcaggacagttgtgaaaata

SEQ ID NO: 434 - DNA, 21 bp, Artificial Sequence
  Synthetic oligonucleotide probe
atgacgctcgtccaaggccac

SEQ ID NO: 435 - DNA, 19 bp, Artificial Sequence
  Synthetic oligonucleotide probe
cccacctgtaccaccatgt

SEQ ID NO: 436 - DNA, 24 bp, Artificial Sequence
  Synthetic oligonucleotide probe
actccaggcaccatctgttctccc

SEQ ID NO: 437 - DNA, 19 bp, Artificial Sequence
  Synthetic oligonucleotide probe
aagggctggcattcaagtc

SEQ ID NO: 438 - DNA, 19 bp, Artificial Sequence
  Synthetic oligonucleotide probe
tgacctggcaaaggaagaa

SEQ ID NO: 439 - DNA, 21 bp, Artificial Sequence
  Synthetic oligonucleotide probe
cagccaccctccagtccaagg

SEQ ID NO: 440 - DNA, 19 bp, Artificial Sequence
  Synthetic oligonucleotide probe
gggtcgtgttttggagaga

SEQ ID NO: 441 - DNA, 20 bp, Artificial Sequence
  Synthetic oligonucleotide probe
ctggccctcagagcaccaat

SEQ ID NO: 442 - DNA, 25 bp, Artificial Sequence
  Synthetic oligonucleotide probe
tcctccatcacttcccctagctcca

SEQ ID NO: 443 - DNA, 24 bp, Artificial Sequence
  Synthetic oligonucleotide probe
ctggcaggagttaaagttccaaga

SEQ ID NO: 444 - DNA, 18 bp, Artificial Sequence
  Synthetic oligonucleotide probe
aaaggacaccgggatgtg

SEQ ID NO: 445 - DNA, 26 bp, Artificial Sequence
  Synthetic oligonucleotide probe
agcgtacactctctccaggcaaccag

SEQ ID NO: 446 - DNA, 22 bp, Artificial Sequence
  Synthetic oligonucleotide probe
caattctggatgaggtggtaga

SEQ ID NO: 447 - DNA, 20 bp, Artificial Sequence
  Synthetic oligonucleotide probe
caggactgagcgcttgttta

SEQ ID NO: 448 - DNA, 21 bp, Artificial Sequence
  Synthetic oligonucleotide probe
caaagcgccaagtaccggacc

SEQ ID NO: 449 - DNA, 18 bp, Artificial Sequence
  Synthetic oligonucleotide probe
ccagacctcagccaggaa

SEQ ID NO: 450 - DNA, 18 bp, Artificial Sequence
  Synthetic oligonucleotide probe
ccctagctgaccccttca

SEQ ID NO: 451 - DNA, 23 bp, Artificial Sequence
  Synthetic oligonucleotide probe
tctgacaagcagttttctgaatc

SEQ ID NO: 452 - DNA, 26 bp, Artificial Sequence
  Synthetic oligonucleotide probe
ctctccccctcccttttcctttgttt

SEQ ID NO: 453 - DNA, 18 bp, Artificial Sequence
  Synthetic oligonucleotide probe
ctctggtgcccacagtga

SEQ ID NO: 454 - DNA, 21 bp, Artificial Sequence
  Synthetic oligonucleotide probe
ccatgcctgctcagccaagaa

SEQ ID NO: 455 - DNA, 23 bp, Artificial Sequence
  Synthetic oligonucleotide probe
caggaaatctggaaacctacagt

SEQ ID NO: 456 - DNA, 20 bp, Artificial Sequence
  Synthetic oligonucleotide probe
ccttgaaaaggacccagttt

SEQ ID NO: 457 - DNA, 22 bp, Artificial Sequence
  Synthetic oligonucleotide probe
atgagtcgcacctgctgttccc

SEQ ID NO: 458 - DNA, 18 bp, Artificial Sequence
  Synthetic oligonucleotide probe
tagcagctgcccttggta

SEQ ID NO: 459 - DNA, 22 bp, Artificial Sequence
  Synthetic oligonucleotide probe
aacagcaggtgcgactcatcta

SEQ ID NO: 460 - DNA, 23 bp, Artificial Sequence
  Synthetic oligonucleotide probe
tgctaggcgacgacacccagacc

SEQ ID NO: 461 - DNA, 18 bp, Artificial Sequence
  Synthetic oligonucleotide probe
tggacacgtggcagtgga

SEQ ID NO: 462 - DNA, 19 bp, Artificial Sequence
  Synthetic oligonucleotide probe
tcatggtctcgtcccattc

SEQ ID NO: 463 - DNA, 27 bp, Artificial Sequence
  Synthetic oligonucleotide probe
caccatttgtttctctgtctccccatc

SEQ ID NO: 464 - DNA, 18 bp, Artificial Sequence
  Synthetic oligonucleotide probe
ccggcatccttggagtag

SEQ ID NO: 465 - DNA, 20 bp, Artificial Sequence
  Synthetic oligonucleotide probe
tccccattagcacaggagta

SEQ ID NO: 466 - DNA, 23 bp, Artificial Sequence
  Synthetic oligonucleotide probe
aggctcttgcctgtcctgctgct

SEQ ID NO: 467 - DNA, 18 bp, Artificial Sequence
  Synthetic oligonucleotide probe
gcccagagtcccacttgt

SEQ ID NO: 468 - DNA, 19 bp, Artificial Sequence
  Synthetic oligonucleotide probe
actgctccgcctactacga

SEQ ID NO: 469 - DNA, 20 bp, Artificial Sequence
  Synthetic oligonucleotide probe
aggcatcctcgccgtcctca

SEQ ID NO: 470 - DNA, 19 bp, Artificial Sequence
  Synthetic oligonucleotide probe
aaggccaaggtgagtccat

SEQ ID NO: 471 - DNA, 20 bp, Artificial Sequence
  Synthetic oligonucleotide probe
cgagtgtgtgcgaaacctaa

SEQ ID NO: 472 - DNA, 24 bp, Artificial Sequence
  Synthetic oligonucleotide probe
tcagggtctacatcagcctcctgc

SEQ ID NO: 473 - DNA, 19 bp, Artificial Sequence
  Synthetic oligonucleotide probe
aaggccaaggtgagtccat

SEQ ID NO: 474 - DNA, 20 bp, Artificial Sequence
  Synthetic oligonucleotide probe
cctactgaggagccctatgc

SEQ ID NO: 475 - DNA, 22 bp, Artificial Sequence
  Synthetic oligonucleotide probe
tccaggtggaccccacttcagg

SEQ ID NO: 476 - DNA, 24 bp, Artificial Sequence
  Synthetic oligonucleotide probe
gggaggcttataggcccaatctgg

SEQ ID NO: 477 - DNA, 50 bp, Artificial Sequence
  Synthetic oligonucleotide probe
ggcttcagcagcacgtgtgaagtcgaagtcgcagtcacagatatcaatga

What is claimed is:

1. An isolated nucleic acid comprising:
   (a) a nucleic acid sequence encoding the polypeptide of (SEQ ID NO: 271);
   (b) a nucleic acid sequence encoding the polypeptide of (SEQ ID NO: 271), lacking its associated signal peptide;
   (c) the nucleic acid sequence of (SEQ ID NO: 270);
   (d) the full-length coding sequence of the nucleic acid sequence of (SEQ ID NO: 270); or
   (e) the full-length coding sequence of the cDNA deposited under ATCC accession number 203277.

2. The isolated nucleic acid of claim 1 comprising a nucleic acid sequence encoding the polypeptide of (SEQ ID NO: 271).

3. The isolated nucleic acid of claim 1 comprising a nucleic acid sequence encoding the polypeptide of (SEQ ID NO: 271), lacking its associated signal peptide.

4. The isolated nucleic acid of claim 1 comprising the nucleic acid sequence of (SEQ ID NO: 270).

5. The isolated nucleic acid of claim 1 comprising the full-length coding sequence of the nucleic acid sequence of (SEQ ID NO: 270).

6. The isolated nucleic acid of claim 1 comprising the full-length coding sequence of the cDNA deposited under ATCC accession number 203277.

7. An isolated nucleic acid encoding a polypeptide having at least 80% sequence identity to:
   (a) the amino acid sequence of the polypeptide of SEQ ID NO: 271;
   (b) the amino acid sequence of the polypeptide of SEQ ID NO: 271, lacking its associated signal peptide;
   (c) the amino acid sequence of the polypeptide encoded by the full-length coding sequence of the nucleic acid sequence of SEQ ID NO: 270; or
   (d) the amino acid sequence of the polypeptide encoded by the full-length coding sequence of the cDNA deposited under ATCC accession number 203277;
   wherein said encoded polypeptide induces chondrocyte proliferation.

8. An isolated nucleic acid encoding a polypeptide having at least 85% sequence identity to:
   (a) the amino acid sequence of the polypeptide of SEQ ID NO: 271;
   (b) the amino acid sequence of the polypeptide of SEQ ID NO: 271, lacking its associated signal peptide;
   (c) the amino acid sequence of the polypeptide encoded by the full-length coding sequence of the nucleic acid sequence of SEQ ID NO: 270; or
   (d) the amino acid sequence of the polypeptide encoded by the full-length coding sequence of the cDNA deposited under ATCC accession number 203277;
   wherein said encoded polypeptide induces chondrocyte proliferation.

9. An isolated nucleic acid encoding a polypeptide having at least 90% sequence identity to:
   (a) the amino acid sequence of the polypeptide of SEQ ID NO: 271;
   (b) the amino acid sequence of the polypeptide of SEQ ID NO: 271, lacking its associated signal peptide;
   (c) the amino acid sequence of the polypeptide encoded by the full-length coding sequence of the nucleic acid sequence of SEQ ID NO: 270; or
   (d) the amino acid sequence of the polypeptide encoded by the full-length coding sequence of the cDNA deposited under ATCC accession number 203277;
   wherein said encoded polypeptide induces chondrocyte proliferation.

10. An isolated nucleic acid encoding a polypeptide having at least 95% sequence identity to:
    (a) the amino acid sequence of the polypeptide of SEQ ID NO: 271;
    (b) the amino acid sequence of the polypeptide of SEQ ID NO: 271, lacking its associated signal peptide;
    (c) the amino acid sequence of the polypeptide encoded by the full-length coding sequence of the nucleic acid sequence of SEQ ID NO: 270; or
    (d) the amino acid sequence of the polypeptide encoded by the full-length coding sequence of the cDNA deposited under ATCC accession number 203277;
    wherein said encoded polypeptide induces chondrocyte proliferation.

11. An isolated nucleic acid encoding a polypeptide having at least 99% sequence identity to:
    (a) the amino acid sequence of the polypeptide of SEQ ID NO: 271;
    (b) the amino acid sequence of the polypeptide of SEQ ID NO: 271, lacking its associated signal peptide;
    (c) the amino acid sequence of the polypeptide encoded by the full-length coding sequence of the nucleic acid sequence of SEQ ID NO: 270; or
    (d) the amino acid sequence of the polypeptide encoded by the full-length coding sequence of the cDNA deposited under ATCC accession number 203277;
    wherein said encoded polypeptide induces chondrocyte proliferation.

12. A vector comprising the nucleic acid of claim 7.

13. The vector of claim 12, wherein said nucleic acid is operably linked to control sequences recognized by a host cell transformed with the vector.

14. An isolated host cell comprising the vector of claim 12.

15. The isolated host cell of claim 14, wherein said cell is a CHO cell, an *E. coil* or a yeast cell.

* * * * *